(12) United States Patent
Hubert et al.

(10) Patent No.: US 8,597,887 B2
(45) Date of Patent: Dec. 3, 2013

(54) GENETIC MARKER IDENTIFICATION IN ATLANTIC COD

(75) Inventors: Sophie Hubert, Halifax (CA); Brent Higgins, Halifax (CA); Sharen Bowman, Halifax (CA); Tudor Borza, Halifax (CA); Jillian Tarrant Bussey, Halifax (CA); Stewart C. Johnson, Nanaimo (CA); Matthew L. Rise, St. John's (CA); J. Andrew B. Robinson, Guelph (CA); Gary Simpson, Halifax (CA); Amber Garber, St. Andrews (CA); Gordon E. Vander Voort, Guelph (CA); Christina E. Hastings, Guelph (CA); Tiago S. Hori, St. John's (CA); Luis O. Afonso, Campbell River (CA); A. Kurt Gamperl, St. John's (CA)

(73) Assignee: Genome Atlantic, Halifax, NS (CA)

( * ) Notice: Subject to any disclaimer, the term of this patent is extended or adjusted under 35 U.S.C. 154(b) by 0 days.

(21) Appl. No.: 13/263,453

(22) PCT Filed: Apr. 9, 2010

(86) PCT No.: PCT/CA2010/000504
§ 371 (c)(1),
(2), (4) Date: Dec. 22, 2011

(87) PCT Pub. No.: WO2010/115275
PCT Pub. Date: Oct. 14, 2010

(65) Prior Publication Data
US 2012/0100996 A1      Apr. 26, 2012

Related U.S. Application Data

(60) Provisional application No. 61/285,354, filed on Dec. 10, 2009, provisional application No. 61/167,979, filed on Apr. 9, 2009.

(51) Int. Cl.
*C12Q 1/68* (2006.01)

(52) U.S. Cl.
USPC ............... 435/6.11; 435/6.1; 435/6.12

(58) Field of Classification Search
USPC .................................. 506/2; 435/6.1
See application file for complete search history.

(56) References Cited

U.S. PATENT DOCUMENTS

| 2006/0024672 A1 | 2/2006 | Lie et al. |
| 2009/0149641 A1 | 6/2009 | Jorgensen et al. |
| 2009/0165156 A1 | 6/2009 | Rengmark et al. |

FOREIGN PATENT DOCUMENTS

WO   WO2008/074101 A2   6/2008

OTHER PUBLICATIONS

Liu et al., "Generation of genome-scale gene-associated SNPs in catfish for the construction of a high-density SNP array," BMC Genomics 2011, 12:53.*

(Continued)

*Primary Examiner* — Samuel Woolwine
*Assistant Examiner* — Kaijiang Zhang
(74) *Attorney, Agent, or Firm* — Bereskin & Parr LLP/S.E.N.C.R.L., s.r.l.; Micheline Gravelle

(57) ABSTRACT

The present application describes SNPs useful for the genetic analysis of Atlantic cod. Also described are QTLs and SNP marker associations for commercially important traits such as weight, nodavirus resistance, resistance to stress and for determining geographic origin. The application also provides methods and uses of the SNPs for identifying family members and/or estimating relatedness, marker assisted selection, breeding programs, population management, identification of geographic origin and trait-association studies. A SNP-based linkage map for Atlantic cod is also provided.

17 Claims, 8 Drawing Sheets

(56) References Cited

OTHER PUBLICATIONS

Sanchez et al., "Single nucleotide polymorphism discovery in rainbow trout by deep sequencing of a reduced representation library," BMC Genomics 2009, 10:559.*
Z.J. Liu et al. "DNA marker technologies and their applications in aquaculture genetics." Aquaculture, vol. 238, No. 1-4, Sep. 1, 2004, pp. 1-37.
Bowman et al., "Generation of genomics resources for Atlantic cod (*Gadus morhua*): progress and plans." Bulletin of the Aquaculture Association of Canada, 2007, 105, 24-30.
Bricknell et al., "Diseases of gadoid fish in cultivation: a review." ICES Journal of Marine Science, 2006, 63:253-266.
Brown et al., "Larviculture of Atlantic cod (*Gadus morhua*): progress, protocols and problems." Aquaculture, 2003, 227, 357-372.
Delghandi et al., "Simultaneous analysis of six microsatellite markers in Atlantic cod (*Gadus morhua*): a novel multiplex assay system for use in selective breeding studies." Marine Biotechnology, 2003, 5, 141-148.
Delghandi et al., "Development of twenty sequence-tagged microsatellites for the Atlantic cod (*Gadus morhua* L.)." Conservation Genetics, 2008, 9(5):1395-1398. (A).
Delghandi et al., "Twenty-three novel microsatellite markers developed from Atlantic cod (*Gadus morhua* L.) expressed sequence tags." Journal of Fish Biology, 2008, 73(2):444-449. (B).
Fan et al., "Robertsonian polymorphism in plaice, *Pleuronectes platessa* L., and cod, *Gadus morhua* L. (Pisces Pleuronectiformes and Gadiformes)." Journal of Fish Biology, 1991, 38:635-640.
Feng et al., "Identification and analysis of differentially expressed genes in immune tissues of Atlantic cod stimulated with formalin-killed atypical *Aeromonas salmonicida*." Physiological Genomics, 2009, 37:149-163.
Garber et al., "Hormonal induction ovulation and spermiation in Atlantic cod (*Gadus morhua*)." Aquaculture, 2009, 296:179-183.
Gjedrem, T. ,"Genetic improvement of cold-water fish species." Aquaculture Research, 2000, 31, 25-33.
Hayes et al., "An extensive resource of single nucleotide polymorphism markers associated with Atlantic salmon (*Salmo salar*) expressed sequences." Aquaculture, 2007, 265, 82-90.
Herlin et al., "Parentage allocation in a complex situation: A large commercial Atlantic cod (*Gadus morhua*) mass spawning tank." Aquaculture, 2007, 272S1, S195-S203. (A).
Herlin et al., "Analysis of the parental contribution to a group of fry from a single day of spawning from a commercial Atlantic cod (*Gadus morhua*) breeding tank." Aquaculture, 2008, 274, 218-224.
Herlin, M.C.G., "Genetic management of Atlantic cod (*Gadus morhua* L.) hatchery populations." Institute of Aquaculture, University of Stirling, Stirling, Scotland, UK, 2007, pp. 222. (B).
Higgins et al., "Characterization of 155 EST-derived microsatellites from Atlantic cod (*Gadus morhua*) and validation for linkage mapping." Molecular Ecology Resources, 2009, 9(3):733-737.
Hubert et al., "Development of single nucleotide polymorphism markers for Atlantic cod (*Gadus morhua*) using expressed sequences." Aquaculture, 2009, 296(1-2):7-14.
Hubert et al., "Development of a SNP resource and a genetic linkage map for Atlantic cod (*Gadus morhua*)." BMC Genomics, 2010, 11:191.
Jakobsdottir et al., "Nine new polymorphic microsatellite loci for the amplification of archived otolith DNA of Atlantic cod, *Gadus morhua*." L. Molecular Ecology Notes, 2006, 6, 337-339.
Johansen et al., "Large-scale sequence analyses of Atlantic cod." New Biotechnol., 2009, vol. 25, No. 5, 263-271.
Miller et al., "Development of tri- and tetranucleotide repeat microsatellite loci in Atlantic cod (*Gadus morhua*)." Molecular Ecology, 2000, 9, 238-243.
Moen et al., "Identification and characterisation of novel SNP markers in Atlantic cod: evidence for directional selection." BMC Genet, 2008, 9, 18.

Moen et al., "A SNP/microsatellite genetic linkage map of the Atlantic cod (*Gadus morhua*)." Anim Genetics, 2009, 40, 993-996.
Nielsen et al., "Genomic signatures of local directional selection in a high gene flow marine organism; the Atlantic cod (*Gadus morhua*)." BMC Evolutionary Biology, 2009; 9 (276), 11, pages ISSN: 1471-2148.
Ødegard et al., "Heritability of resistance to viral nervous necrosis in Atlantic cod (*Gadus morhua* L.)." Aquaculture, 2010, 300:59-64.
O'Reilly et al., "Isolation of twenty low stutter di- and tetranucleotide microsatellites for population analyses of walleye pollock and other gadoids." Journal of Fish Biology, 2000, 56, 1074-1086.
Pogson et al., "Genetic population structure and gene flow in the Atlantic cod *Gadus morhua*: a comparison of allozyme and nuclear RFLP loci." Genetics, 1995, 139:375-385.
Rise et al., "Functional genomic analysis of the response of Atlantic cod (*Gadus morhua*) spleen to the viral mimic polyriboinosinic polyribocytidylic acid (pIC)." Dev Comp Immunol., 2008, 32(8):916-931.
Ruzzante et al., "Genetic differentiation between inshore and offshore Atlantic cod (*Gadus morhua*) off Newfoundland: Microsatellite DNA variation and antifreeze level." Canadian Journal of Fisheries and Aquatic Sciences, 1996, 53:634-645.
Symonds et al., "Family-based Atlantic cod (*Gadus morhua*) broodstock development." Bulletin of the Aquaculture Association of Canada, 2007, 105, 39-46.
Wesmajervi et al., "Genotyping of Atlantic cod (*Gadus morhua* L.) using five microsatellite markers and a population specific single nucleotide polymorphism." Aquaculture, 2007, 272S1:S317-S318.
Booman et al., "Development and experimental validation of a 20K Atlantic cod (*Gadus morhua*) oligonucleotide microarray based on a collection of over 150,000 ESTs." Marine Biotechnology, 2011, 13(4), 733-750.
Borza et al., "Atlantic cod (*Gadus morhua*) CC chemokines: Diversity and expression analysis." Developmental and Comparative Immunology, 2010, 34 (8), 904-913.
Bowman et al., "An integrated approach to gene discovery and marker development in Atlantic cod (*Gadus morhua*)." Marine Biotechnology, 2011, 13 (2), 242-255.
Bradbury et al., "Parallel adaptive evolution of Atlantic cod on both sides of the Atlantic Ocean in response to temperature." Proceedings of the Royal Society of London Biological Sciences B., 2010, 277: 1701.
Bradbury et al., "Evaluating SNP ascertainment bias and its impact on population assignment in Atlantic Cod, *Gadus morhua*." Molecular Ecology Resources, 2011, 11 (Supplement 1), 218-225.
Campbell et al., "Characterization of 22 novel single nucleotide polymorphism markers in steelhead and rainbow trout." Molecular Ecology Resources, 2009, 9, 318-322.
Feng et al., "Characterization and expression analyses of anti-apoptotic Bcl-2-like genes NIZ-13, Mcl-1, Bcl-X1, and Bcl-X2 in Atlantic cod (*Gadus morhua*)." Molecular Immunology, 2010, 47 (4), 763-784.
Hori et al., "Heat shock-responsive genes identified and validated in Atlantic cod (*Gadus morhua*) liver, head kidney and skeletal muscle using genomic techniques." BMC Genomics, 2010, 11(2), 72.
Hori et al., "Inter-Individual and -Family differences in the cortisol responsiveness of Atlantic cod (*Gadus morhua*)." Aquaculture, 2011, doi:10.1016/j.aquaculture.2011.10.040 (in press). (A).
Hori et al., "The mRNA expression of cortisol axis related genes differs in Atlantic cod (*Gadus morhua*) categorized as high or low responders." General and Comparative Endocrinology, 2011, doi:10.1016/j.ygcen.2011.11.031 (In press). (B).
Rise et al., "Impact of asymptomatic nodavirus carrier state and intraperitoneal viral mimic injection on brain transcript expression in Atlantic cod (*Gadus morhua*)." Physiological Genomics, 2010, 42 (2), 266-280.

* cited by examiner

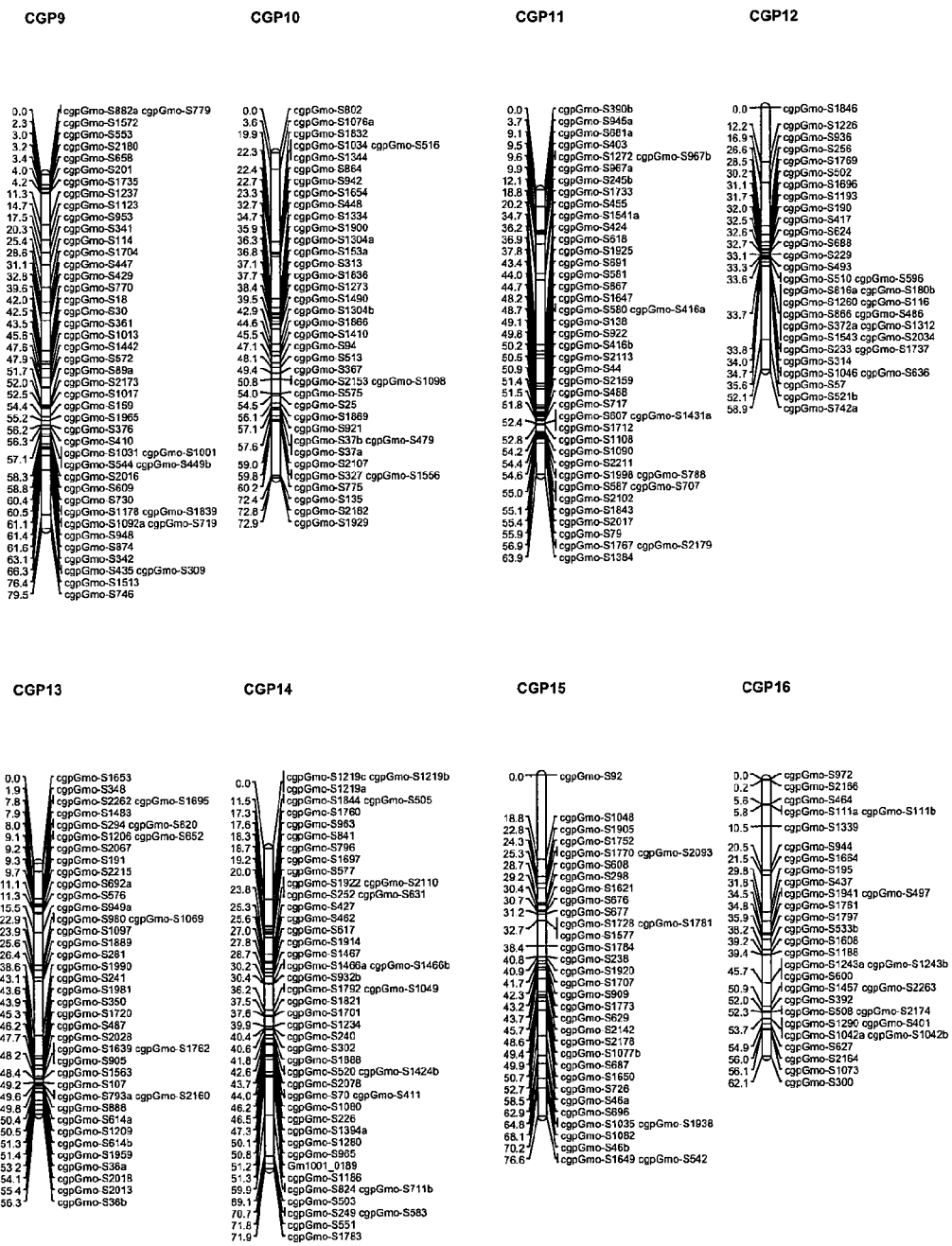
Figure 5 (con't.)

Figure 5 (con't.)
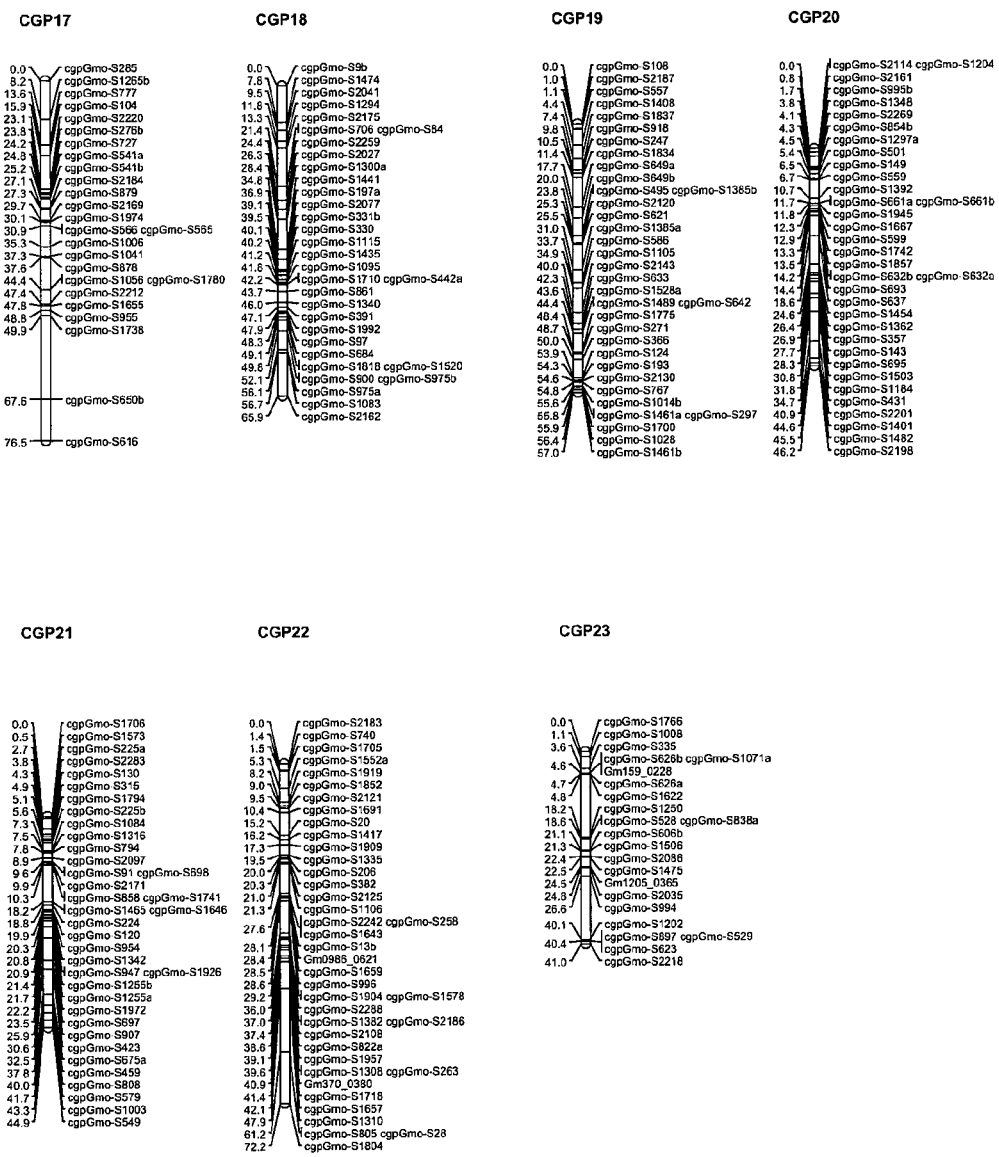

GENETIC MARKER IDENTIFICATION IN ATLANTIC COD

CROSS REFERENCE TO RELATED APPLICATIONS

This application is a U.S. National Phase filing under 35 USC 371 of PCT/CA2010/000504 filed Apr. 9, 2010 claiming priority under 35 USC 119(e) from U.S. Provisional Patent Application No. 61/167,979 filed Apr. 9, 2009, and U.S. Provisional Patent Application No. 61/285,354 filed Dec. 10, 2009 all of which are incorporated herein by reference in their entirety.

INCORPORATION OF SEQUENCE LISTING

A computer readable form of the Sequence Listing "20683-8_SequenceListing.txt" (966,656 bytes), submitted via EFS-WEB and created on Oct. 4, 2011, is herein incorporated by reference.

Please replace the Sequence Listing currently of record with the Sequence Listing provided herewith in text format in computer readable form only.

FIELD

This application relates to single nucleotide polymorphism (SNP) markers and associated methods for the genetic analysis of Atlantic cod (*Gadus morhua*) and more specifically to SNP markers and associated methods for desirable production traits in Atlantic cod.

BACKGROUND

The Atlantic cod (*Gadus morhua*) has a long history as a commercially important species in the North Atlantic and adjacent waters. The decline in the capture fishery has resulted in a shift towards the production of Atlantic cod using aquaculture in a number of countries, including Canada. Selective breeding is a proven, powerful approach in the enhancement of domesticated species for food production. In order to develop an efficient breeding program, it is desirable to generate suitable molecular tools in order to accelerate the selection process. The application of genetic tools in finfish aquaculture breeding programs has only recently become standard practice (De-Santis and Jerry, 2007). Currently, 10 out of 19 major aquaculture species are being produced using selective breeding for improved broodstock selection and new tools are being developed to make selection more precise with the ability to identify and locate quantitative trait loci and then use markers assisted selection to speed the selection process (Hershberger, 2006).

Accordingly, a dense linkage map linked to traits of economic importance would represent one of the most useful genomic tools for application in the selective breeding of Atlantic cod. A variety of different marker types such as amplified fragment length polymorphisms (AFLPs), microsatellite markers or SNP markers can be used for linkage mapping or association mapping. SNPs have become a focus of marker development in many species in recent years due to their abundance and low cost of genotyping allowing the construction of a high density map. In aquaculture species, SNPs are especially important if they cause differences in economic traits or are linked to such a trait. SNPs developed from collections of expressed sequence tags (ESTs) can be particularly valuable as they can be used to identify changes in the amino acid sequence of encoded proteins, also known as non-synonymous SNPs (Kim et al., 2003).

The increased number of ESTs available for fish has facilitated the detection of SNPs for different fish species. Significant numbers of SNPs have been reported in channel catfish (He et al., 2003), salmon (Hayes et al., 2007; Smith et al., 2005) and sea bream (Cenadelli et al., 2007).

With respect to Atlantic cod, Moen et al. (2008) recently developed a large number of SNPs from ESTs based on 5' sequence reads. One SNP has also been identified for the pantophysin (Pan I) locus (Delghandi et al., 2007)

There remains a need for high quality SNP markers and SNP markers associated with traits of commercial importance suitable for the genetic analysis of Atlantic cod.

SUMMARY OF THE DISCLOSURE

The present disclosure provides a large number of single nucleotide polymorphisms (SNPs) useful for the genetic analysis of Atlantic cod. Both a low throughput and a high throughput (automated) SNP detection pipeline were developed and a subset of SNPs identified by these alternate approaches was validated. More specifically, 17,365 putative SNPs were identified through the sequence analysis of 97,964 EST sequence reads assembled into 8,189 contigs. Of the 17,365 putative SNPs, 4,753 SNPs were identified as high quality SNPs based on frequency and quality of sequence data. The 3072 SNPs listed in Table 6 were then hand selected from the 4,753 high quality SNPs based on origin and relevance to project objectives. SEQ ID NOs: 1-3072 provide the flanking sequence with the SNP variant at nucleotide position 61 for each of the 3072 SNPs listed in Table 6.

In addition, the 47 SNPs shown in Table 1 were characterized in 22 Atlantic cod fish from two separate populations of fish from New Brunswick and Newfoundland. Of the 47 SNPs, suitable primer extension assays were developed for the 33 SNPs identified in Table 3. As shown in Table 2, 30 of these SNPs appeared to be polymorphic in the two populations. Further segregation analysis showed that 22 of the SNPs were inherited as expected according to Mendelian segregation (Table 3). Annotation of the sequences shown in Table 5 identified 9 SNPs in specific untranslated gene regions, 2 synonymous coding SNPs and 2 non-synonymous coding SNPs. Table 7 identifies SNPs that overlap between Table 1 and Table 6 and provides corresponding SEQ ID NOS. and SNP nucleotide positions for the SNPs of Table 1.

Accordingly, the disclosure provides for a method of identifying an animal associated with a specific phenotype or trait comprising testing the animal for one or more of the SNPs listed in Table 1 or Table 6, wherein the SNP is associated with a specific phenotype or trait.

The disclosure also provides a method of identifying an association between a SNP and a specific phenotype or trait in an animal comprising comparing the frequency of a SNP allele identified in Table 1 or Table 6 between a control population and a population selected for the specific phenotype or trait.

In a preferred embodiment, the animal is Atlantic cod (*Gadus morhua*), however the SNPs are expected to be useful in the genetic analysis of other 'related' fish species within the family Gadidae.

Genetic analysis using the SNPs described herein provides useful information for breeding programs. Accordingly, one aspect of the disclosure provides a method of selecting a fish for a breeding program comprising testing fish for one or more of the SNPs listed in Table 1 or Table 6 and selecting fish for the breeding program based on the presence or absence of the one or more SNP alleles.

In one aspect, the disclosure provides for determining the parentage of a fish comprising genotyping a sample of fish for one or more SNPs listed in Table 14 wherein the sample includes parent fish (dams/sires) and progeny. In one embodiment, the method includes selecting a fish with unknown parentage and determining the parentage of the fish by comparing the genotypes of the SNP alleles for the parent fish with the genotypes of the SNP alleles for each of the fish genotyped in the sample. In one embodiment, the sample comprises fish that are communally-reared fish. In one embodiment, the method comprises typing at least 16, 20, 24, 30 or 36 of the SNPs listed in Table 14.

The SNPs of the present disclosure are useful for the linkage analysis or association analysis of Atlantic cod. The SNPs are also useful for identifying family members or estimating relatedness of Atlantic cod.

In a further embodiment, the disclosure provides isolated nucleic acid molecules that comprise the SNPs identified herein. In one embodiment, the isolated nucleic acid molecules comprise the SNPs identified in Table 1 or Table 6. In a further embodiment, the disclosure provides the nucleic acid molecules comprising the sequences identified in Table 7.

In another embodiment, the disclosure provides a method of genotyping a sample for a SNP comprising amplifying a nucleic acid molecule from said sample using one of the primer pairs identified in Table 6 and assaying for the SNP using the corresponding interrogation primer identified in Table 6.

The 3072 SNPS identified in Table 6 were tested using two Illumina GoldenGate panels. 1620 of these SNPs were categorised as validated (V) SNPs as set out in Example 2 and identified in Table 6. Validated SNPs were tested for Mendelian segregation in two families and used to create a high-density genetic linkage map useful for the genetic analysis of cod. Accordingly, in one embodiment, the disclosure provides a linkage map for cod as shown in FIG. 5. In another embodiment, the disclosure provides a linkage map for cod as shown in Table 10. In one embodiment, there is provided the validated SNPs identified in Table 6, with the proviso that they are not listed in Table 13.

In one aspect, the SNPs identified herein may be used for determining the geographic origin of cod. The 184 SNPs listed in Table 11 are monomorphic in Eastern Atlantic cod populations (Iceland, Ireland and Norway) and polymorphic in Western Atlantic cod populations. Accordingly, there is provided a method for determining the geographic origin of a codfish comprising genotyping the codfish for one or more of the SNPs listed in Table 11, wherein fish that have homozygous genotypes are from the Eastern Atlantic, and fish that have heterozygous genotypes are from the Western Atlantic.

In one embodiment, the SNPs identified in Table 12 are useful for determining the geographic origin of cod fish, and in particular distinguishing codfish from Northern populations such as Newfoundland and Northern Norway/Barents Sea (which only have distinct 'Northern' genotypes present in populations), from codfish from Ireland and other populations that exhibit a distinct Southern genotype, or a mixed genotype with both Northern and Southern genotypes present in populations. Accordingly, in one embodiment there is provided a method for determining the geographic origin of codfish comprising genotyping one or more of the SNPs in Table 12. In one embodiment, a fish is identified as not from Newfoundland or Northern Norway if it has one or more Southern genotype alleles as set out in Table 12.

In one aspect, there is provided a method for identifying codfish with desirable production traits. In one embodiment, desirable production traits include increased weight, disease resistance, and resistance to stress. In one aspect, a quantitative trait locus (QTL) associated with the weight of codfish has been identified on linkage group 7 (Tables 10 and 20). In another embodiment, QTLs associated with the weight of codfish have been identified on linkage groups 1, 11, 18, 22 and 23 (Tables 10 and 21). Accordingly, in one embodiment, there is provided a method of identifying a codfish with QTL for increased weight, the method comprising genotyping the codfish for one or more of the SNPs listed in Tables 20 or 21, or genotyping a marker in linkage disequilibrium with any one of the SNP marker alleles listed in Tables 20, or 21. In one embodiment, the presence of a marker allele in linkage disequilibrium with the preferred SNP marker allele listed in Tables 20 or 21 indicates the presence of the QTL for increased weight.

In another aspect, markers associated with resistance to nodavirus infection have been identified on linkage groups 8, 19 and 23. Accordingly, in one embodiment there is provided a method of identifying a codfish resistant to nodavirus infection, the method comprising genotyping the codfish for one or more of the SNPs listed in Table 18.

In another aspect, there is provided genetic markers associated with fish that have a QTL for resistance to handling stress. In one embodiment, fish with the preferred alleles shown in Table 24 exhibit lower levels of cortisol in response to handling stress. Accordingly, in one embodiment there is provided a method of identifying a codfish resistant to stress, the method comprising genotyping the codfish for one or more of the SNPs listed in Table 24.

In one aspect, fish may be selected for a plurality of trait-associated markers as described herein. In one embodiment, a fish may be selected for SNP markers for growth, nodavirus resistance, and/or stress resistance as described herein. In one embodiment, there is provided a method for selecting fish with a plurality of genetic markers for desirable production traits such as growth, nodavirus resistance and stress resistance.

Other features and advantages of the present invention will become apparent from the following detailed description. It should be understood, however, that the detailed description and the specific examples while indicating preferred embodiments of the invention are given by way of illustration only, since various changes and modifications within the spirit and scope of the invention will become apparent to those skilled in the art from this detailed description.

BRIEF DESCRIPTION OF THE DRAWINGS

The invention will now be described in relation to the drawings in which.

DETAILED DESCRIPTION

The present inventors have identified a large number of SNPs useful for the genetic analysis of Atlantic cod presented in Tables 1 and 6.

Figure 1:
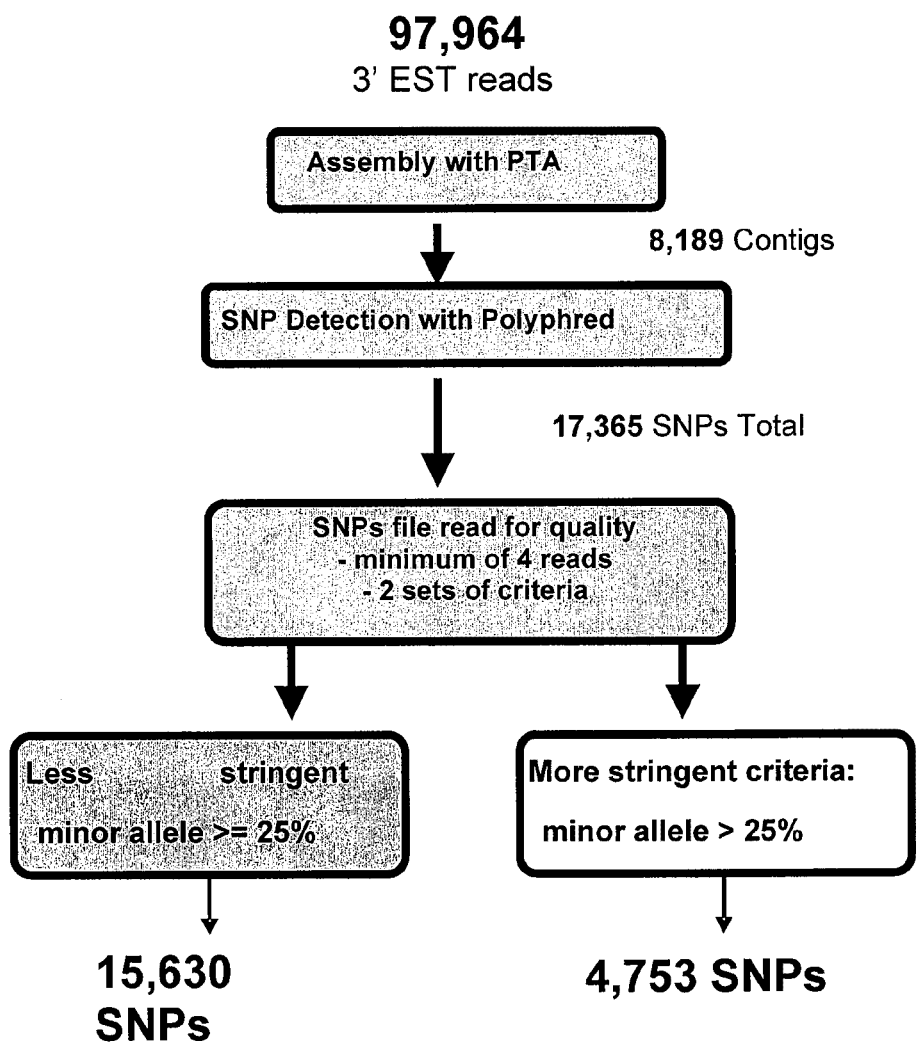
FIG. 1 provides an overview of automated SNP detection. The ESTs are processed using Paracel Transcript Assembler (PTA) to assemble contigs and to remove unwanted sequence. Contigs in ace file format are used as PolyPhred input, to look for SNPs in areas of multi-read coverage. The output of PolyPhred is further refined using a custom perl script that can be adjusted to select various SNP output qualities. Two examples of criteria sets are shown. Both sets require a minimum of 4 read coverage. The less stringent set identifies SNPs that have a minor allele representation equal to or greater than 25%—for example, for a contig region with 4 contributing reads it would detect SNPs with 1 copy of the minor allele and 3 copies of the major allele. The more stringent set requires a minor allele representation greater than 25%, which means that each allele is represented at least twice in contigs containing 4 reads or more.

Referring to FIG. 1, SNP selection was completed as follows: 97,964 3' EST (Expressed Sequence Tag) reads were assembled with PTA (Paracel Transcript Assembler—used for EST cleaning, clustering and assembly) resulting in 8,189 contigs. SNP detection was performed with PolyPhred which is a program that compares sequence information to identify heterozygous sites for single nucleotide substitutions. Analysis outputs included a ranking which indicates quality of the SNPs estimated by bioinformatic analysis (not shown), which was used towards SNP selection. Initial SNP detection yielded 17,365 putative SNPs. This list was trimmed using various criteria to identify 4,753 SNPs that were high quality. Specifically, "predicted frequent" SNPs were selected from contiguous sequences (contigs) which contained 4 or more sequence reads. In addition, from these "predicted frequent" SNPs, for 4,753 of these SNPs, the minor allele was represented in a minimum of 2 of the 4 reads. From these 4,753 SNPs, the 3072 SNPs listed in Table 6 were then hand-selected based on origin and relevance to project objectives.

The 47 SNPs identified in Table 1 were identified and selected for further characterization as set out in Example 1. Primer extension assays for these SNPs were developed and amplification and interrogation primers suitable for the amplification and genotyping of the SNPs are shown in Table 6. The SNPs shown in Table 2 were genotyped and further characterized with respect to segregation in two populations of Atlantic Canadian cod. Sequences containing the SNPs were also annotated with respect to gene location and putative SNP functionality (synonymous vs. nonsynonymous changes).

The term "SNP" as used herein, means a single nucleotide polymorphism which is a single nucleotide position in a nucleic acid sequence for which two or more alternative alleles are present in a given population.

The term "allele" means any one of a series of two or more different gene sequences that occupy the same position or locus on a chromosome.

The term "genotype" means the specification of an allelic composition at one or more loci within an individual organism. In the case of diploid organisms such as codfish, there are two alleles at each locus; a diploid genotype is said to be homozygous when the alleles are the same, and heterozygous when the alleles are different.

As used herein "genotyping" refers to determining the genotype of a organism at a particular locus, such as a SNP.

As used herein, "quantitative trait locus" or "QTL" refers to a genetic locus that contributes, at least in part, to the phenotype of an organism for a trait that can be numerically measured.

SNP Markers and Linkage and Association Studies

In one embodiment, the SNPs of the present disclosure can be used as markers for identifying animals that contain a SNP allele associated with a specific trait or phenotype. In a further embodiment, the SNPs can be used as markers that are associated with a quantitative trait locus (QTL). In a preferred embodiment, the animals are Atlantic cod fish.

The SNPs of the present disclosure may be used in genetic linkage or association studies to identify SNP alleles that are associated with a specific phenotype or QTL. In one embodiment, the linkage maps provided in FIG. 5 or Table 10 are useful for the genetic analysis of Atlantic cod. A person skilled in the art would readily be able to design linkage or association studies using the SNPs of Table 1 or Table 6 in order to identify SNPs that are linked or associated with a specific trait, phenotype or QTL. For example, a SNP associated with a trait or phenotype may be identified by comparing the frequency of a particular SNP allele in a control population and a test population selected for the presence of a specific trait or phenotype. Alleles that are present in a higher frequency in the test population compared to the control population are associated with the specific trait or phenotype. Examples of such traits or phenotypes include rapid growth, disease resistance, tolerance to handling stress, tolerance to thermal stress, high survival rates, low incidence of deformity or other traits of interest which would benefit aquaculture production. Methods of identifying QTL associated with a specific SNP allele are also known in the art. Examples of quantitative traits for which the SNPs of the present disclosure may be associated also include rapid growth, disease resistance, tolerance to handling stress, tolerance to thermal stress, high survival rates, low incidence of deformity or other traits of interest which would benefit aquaculture production.

Marker Assisted Selection

In a further embodiment, the SNP markers of the present disclosure may be used in Marker Assisted Selection (MAS), wherein fish enrolled in a breeding program are checked for the presence or absence of one or more SNP marker alleles. For example, fish having a specific SNP allele associated with a particular trait may be identified and put into a breeding program in order to select for offspring that also carry that marker. In one embodiment, the SNPs alleles or molecular markers identified herein will be associated with fish that perform well or poorly under aquaculture conditions. Accordingly, the SNPs can be used to non-lethally screen potential broodstock for traits of interest. For example, a piece of a fin can be obtained from a fish from a breeding program, and DNA can be extracted and analyzed to determine whether a SNP allele associated with a trait of interest is present. If the SNP allele is present, that fish would be desirable to include in a breeding program. In one embodiment, fish enrolled in a breeding program are checked for the presence or absence of a plurality of SNP markers alleles associated with a trait as described herein.

Identification of Family Members and Estimation of Relatedness

The SNP markers of the present disclosure may also be used to design targeted panels of markers used for the estimation of measures of relatedness. In one embodiment, measures of relatedness derived from the SNPs of the present disclosure may be used to ensure that crosses in breeding programs are not made between individuals that are too closely related.

In another embodiment, the SNPs of the present disclosure may be used to identify family members associated with a particular fish. For example, the SNPs may be used to identify parents of untagged progeny. As set out in Example 3, the present disclosure provides a set of SNPs listed in Table 14 that can be used to determine the parentage of fish, and in particular codfish. In a further embodiment, the SNPs listed in Table 14 can be used to estimate the relatedness of two or more fish. In one embodiment, the methods and SNPs described herein can also be used to identify siblings. In one embodiment, the SNPs identified in Table 14 can be used to identify the parentage of a fish by genotyping as few as 16 SNPs. In other embodiments, more than 16, more than 20 or more than 24 of the SNPs listed in Table 14 can be used to identify the parentage or estimate the relatedness of two or more fish.

Population Management and Analysis—Geographic Origin

The SNPs of the present disclosure may also be used in population management for fisheries, or in population analysis of Atlantic cod stocks. In a further embodiment, the SNPs may be used in forensics/compliance activities, such as determining where fish originated. For example, the SNPs may be used to differentiate between fish caught in different geographic areas that are associated with a specific allele or combinations of alleles.

In one embodiment, there is provided a method for determining the geographic origin of cod based on SNP genotypes. As set out in Example 2 and Tables 11 and 12, codfish from specific geographic areas have been shown to carry a specific set of genotypes which distinguishes fish caught in different areas.

As used herein "Eastern Atlantic Cod" refers to cod fish that are endemic to the European Atlantic seaboard including Iceland, Norway, Ireland and Great Britain. As used herein "Western Atlantic Cod" refers to fish that are endemic to the Canadian Atlantic seaboard including Newfoundland, Nova Scotia and New Brunswick as well as the Atlantic seaboard of the United States of America.

As used herein, a fish with that is not from Newfoundland or Northern Norway (Barents Sea), refers to codfish that are endemic to other areas of the Atlantic such as Ireland, Iceland, Georges Bank, or Cape Sable.

Genetic Markers for Production Traits

The present disclosure also provides genetic markers for production traits for Atlantic cod. Screening codfish for these markers can help identify commercially important breeding stocks or fish with more desirable production traits suitable for use in commercial aquaculture.

As set out in Example 4 and Table 18, SNP alleles that are associated with resistance to nodavirus infection in codfish have been identified. Identifying fish harboring the alleles identified in Table 18 can therefore be used to select cod fish suitable for breeding stocks or acquaculture that are less susceptible to nodavirus infection.

SNPs and specific alleles associated with growth and/or weight in Atlantic cod have also been identified as set out in Example 5. Identifying fish that harbour these QTLs for growth and/or weight can allow the selection of fish for use as parents in breeding programs, or the selection of fish at a young age that are more likely to develop into adult fish with desirable traits such as increased weight or size. Accordingly, in one embodiment fish harbouring growth and/or weight QTLs can be identified by screening for the SNPs alleles associated with increased weight or growth identified in Tables 20 or 21.

In another embodiment, SNPs and specific alleles associated with resistance to stress have been identified as set out in Example 7 and Table 24. Fish that are resistant to stress are better suited for breeding stocks and commercial aquaculture.

A person of skill in the art will appreciate that a fish can be identified that have a particular trait by genotyping the fish for one of the SNPs identified herein and determining whether they have one of the alleles shown to be associated with the trait as described herein, it is also possible to identify fish that have a particular trait by genotyping for markers that are in linkage disequilibrium (LD) wherein one of the alleles of that marker is in LD with one of the alleles shown to be associated with the trait as described herein. As used herein "linkage disequilibrium" refers to the co-segregation of alleles at different loci on a chromosome such that the presence of one allele is indicative of the presence of the other allele. Furthermore, a person of skill in the art would readily be able to identify markers and alleles in linkage disequilibrium on a common halpotype with the SNPs shown to be associated with particular traits identified herein.

A person of skill in the art will also appreciate that the methods and genetic markers described herein can be used to select fish for multiple markers. For example, in one embodiment the fish are selected for genetic markers associated with growth, nodavirus resistance and/or resistance to handling stress. When applying marker assisted selection (MAS) to breeding programs, single trait selection is not necessarily a desirable method to apply in production systems. It is possible, for example that selecting only for one beneficial trait could have the unexpected and undesirable result of selecting for a linked undesirable trait if precautions are not taken. For example, selecting only for improved growth when developing a breeding population for animal production could result in fast growing, and immune susceptible animals. When using MAS, best practices in development of broodstock for production include selection for multiple traits, where possible, such as improved growth, disease resistant and stress tolerance.

Isolated SNP-Containing Nucleic Acid Molecules

Table 6 identifies the corresponding SEQ ID NO. for each of the 3,072 SNPs identified in the present disclosure. Table 7 identifies the corresponding SEQ ID NO: for each of the SNPs of Table 1. Accordingly, one embodiment provides a nucleic acid sequence identified in Table 6 or 7 that comprises either one of the SNP alleles. In a further embodiment, the disclosure provides isolated nucleic acid molecules that comprise one or more of the SNPs identified in Tables 6 or 7. A further embodiment includes amplification primers and interrogation primers for the sequences and SNPs identified in Tables 6 or 7. A person skilled in the art would readily identify suitable amplification primers and interrogation primers based on the sequences identified in Tables 6 or 7 and common general knowledge in the art.

The term "isolated nucleic acid" refers to a nucleic acid substantially free of cellular material or culture medium, for example, when produced by recombinant DNA techniques, or chemical precursors, or other chemicals when chemically synthesized. An "isolated nucleic acid" is also substantially free of sequences which naturally flank the nucleic acid (i.e. sequences located at the 5' and 3' ends of the nucleic acid) from which the nucleic acid is derived. The term "nucleic acid" is intended to include DNA and RNA and can be either double stranded or single stranded.

Detecting SNP Variants

A person skilled in the art will appreciate that a number of methods can be used to measure or detect the presence of the SNPs identified in the present disclosure. For example a variety of techniques are known in the art for detecting a SNP within a sample, including genotyping, microarrays, Restriction Fragment Length Polymorphism, Southern Blots, SSCP, dHPLC, single nucleotide primer extension, allele-specific hybridization, allele-specific primer extension, oligonucleotide ligation assay, and invasive signal amplification, Matrix-assisted laser desorption/ionization time-of-flight (MALDI-TOF) mass spectrometry, and Fluorescence polarization (FP). Such methods optionally employ the isolated nucleic acid molecules of the disclosure.

Accordingly, the SNPs are detected in one embodiment by genotyping. Methods of genotyping are well known in the art. In one method, primers flanking the SNP are selected and used to amplify the region comprising the SNP. The amplified region is then sequenced using DNA sequencing techniques known in the art and analyzed for the presence of the SNP alleles.

In another embodiment, the method of detecting a SNP comprises using a probe. For example, in one embodiment an amplified region comprising the SNP is hybridized using a composition comprising a probe specific for the SNP allele under stringent hybridization conditions.

Accordingly, one aspect of the disclosure includes isolated nucleic acids that bind to SNP alleles at high stringency that are used as probes to determine the presence of the allele. In a particular embodiment, the nucleic acids are labeled with a detectable marker. The marker or label is typically capable of producing, either directly or indirectly, a detectable signal.

For example, the label may be radio-opaque or a radioisotope, such as $^3H$, $^{14}C$, $^{32}P$, $^{35}S$, $^{123}I$, $^{125}I$, $^{131}I$; a fluorescent (fluorophore) or chemiluminescent (chromophore) compound, such as fluorescein isothiocyanate, rhodamine or luciferin; an enzyme, such as alkaline phosphatase, beta-galactosidase or horseradish peroxidase; an imaging agent; or a metal ion.

The term "probe" refers to a nucleic acid sequence that will hybridize to a nucleic acid target sequence. In one example, the probe hybridizes to a sequence comprising a specific SNP allele or its complement under stringent conditions, but will not to the corresponding alternative allele or its complement. The length of probe depends on the hybridization conditions and the sequences of the probe and nucleic acid target sequence. In one embodiment, the probe is 8-100, 8-200 or 8-500 nucleotides in length, such as 1-7, 8-10, 11-15, 16-20, 21-25, 26-50, 51-75, 76-100, 101-150 or 151-200 nucleotides in length or at least 200, 250, 400, 500 or more nucleotides in length. In other embodiments, 10, 15, 20 or 25 nucleotides provide a lower end for the aforementioned nucleotide ranges.

In a further embodiment, the SNPs are detected using a primer extension assay. Briefly, an interrogation primer is hybridized to the sequence nucleotides immediately upstream of the SNP nucleotide. A DNA polymerase then extends the hybridized interrogation primer by adding a base that is complementary to the SNP. The primer sequence containing the incorporated base is then detected using methods known in the art. In one embodiment, the added base is a fluorescently labeled nucleotide. In another embodiment, the added base is a hapten-labelled nucleotide recognized by antibodies.

The SNPs described herein are optionally detected using restriction enzymes. For example, amplified products can be digested with a restriction enzyme that specifically recognizes sequence comprising one of the SNP alleles, but does not recognize the other allele. In one embodiment PCR is used to amplify DNA comprising a SNP, amplified PCR products are subjected to restriction enzyme digestion under suitable conditions and restriction products are assessed. If for example a specific SNP allele corresponds to a sequence digested by the restriction enzyme, digestion is indicative of detecting that particular SNP allele. Restriction products may be assayed electrophoretically as is common is the art.

SNP alleles can also be detected by a variety of other methods known in the art. For example, PCR and RT-PCR and primers flanking the SNP can be employed to amplify sequences and transcripts respectively in a sample comprising DNA (for PCR) or RNA (for RT-PCR). The amplified products are optionally sequenced to determine which of the SNP alleles is present in the sample.

Accordingly, the disclosure provides in one aspect, methods and nucleic acid molecules useful for detecting SNPs. In one embodiment, a sample comprising genomic DNA is obtained and primers flanking the SNP are used to amplify the region comprising the mutation. Sequencing is optionally employed to determine which SNP allele is present in the sample. In another embodiment, a sample comprising RNA is reverse transcribed, primers flanking the SNP are used to amplify the region comprising the SNP, and sequencing is employed to determine which SNP allele is present in the sample. In another embodiment the SNP is detected using a composition comprising a probe specific for the mutated sequence.

Alternatively SNP alleles are optionally detected by a variety of other techniques known in the art including microarrays, hybridization assays, PCR based assays, molecular beacons, Dynamic allele-specific hybridization (DASH) and/or combinations of these.

In one embodiment, the disclosure includes isolated nucleic acid molecules that selectively hybridize under stringent conditions to one of the sequences listed in Tables 7 or 8. A further embodiment includes an isolated nucleic acid molecule that selectively hybridizes to a nucleic acid comprising a SNP allele or its complement.

The phrase "specifically hybridizes to a SNP allele or its complement" means that under the same conditions, the isolated nucleic acid sequence will preferentially hybridizes to one of the SNPs alleles or its complement, as compared to the other allele.

The term "hybridize" refers to the sequence specific non-covalent binding interaction with a complementary nucleic acid. In a preferred embodiment, the hybridization is under high stringency conditions.

By "high stringency conditions" it is meant that conditions are selected which promote selective hybridization between two complementary nucleic acid molecules in solution. Hybridization may occur to all or a portion of a nucleic acid sequence molecule. The hybridizing portion is typically at least 5-14, 15-20, 21-25, 26-30, 31-40, 41-50 or 50, 50-100, 100-200 or 200 or more or more nucleotides in length. Those skilled in the art will recognize that the stability of a nucleic acid duplex, or hybrids, is determined by the Tm, which in sodium containing buffers is a function of the sodium ion concentration and temperature (Tm=81.5° C.−16.6 (Log 10 [Na+])+0.41(% (G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5× Denhardt's solution/1.0% SDS at Tm-5° C. for 15 minutes based on the above equation, followed by a wash of 0.2×SSC/0.1% SDS at 60° C. It is understood, however, that equivalent stringencies may be achieved using alternative buffers, salts and temperatures. Additional guidance regarding hybridization conditions may be found in: Current Protocols in Molecular Biology, John Wiley & Sons, N.Y., 1989, 6.3.1-6.3.6 and in: Sambrook et al., Molecular Cloning, a Laboratory Manual, Cold Spring Harbor Laboratory Press, 1989, Vol. 3.

Nucleic acid sequences that are primers are useful to amplify DNA or RNA sequences containing a SNP of the present disclosure. Accordingly, in one embodiment, the disclosure provides a composition comprising at least one isolated nucleic acid sequence that is a specific primer able to amplify a sequence comprising a SNP identified in Table 1 or Table 6. A person skilled in the art would understand how to identify and test primers that are useful for amplifying sequences containing the SNPs identified in Table 6.

The above disclosure generally describes the present application. A more complete understanding can be obtained by reference to the following specific examples. These examples are described solely for the purpose of illustration and are not intended to limit the scope of the disclosure. Changes in form and substitution of equivalents are contemplated as circumstances might suggest or render expedient. Although specific terms have been employed herein, such terms are intended in a descriptive sense and not for purposes of limitation.

The following non-limiting examples are illustrative of the present disclosure:

EXAMPLES

Example 1

Development of Single Nucleotide Polymorphism Markers for Atlantic Cod (*Gadus morhua*) Using Expressed Sequences Materials and Methods
EST Sequencing and Analysis
Information provided for this example is also described in Hubert et al. 2009. Tissue samples and methods used for RNA extraction, construction of normalized cDNA libraries, DNA sequencing and EST clustering have been described in detail previously (Bowman et al., 2007). In brief, directionally-cloned, normalized cDNA libraries were constructed using the Creator Smart cDNA kit (Clontech). Sequences were generated from the 3' direction and basecalling was performed using Phred. After trimming to remove vector and other sequence contaminants and masking in regions of low quality, ESTs were clustered using Paracel Transcript Assembler (PTA), with the cluster threshold parameter set to a value of 100, a match score of 1, a mismatch score of −3 and a hit length of 75 bp which lead to a minimum similarity of 98%. PTA initially groups similar sequences together within clusters, then attempts to assemble sequences within each cluster. Thus, PTA generates a set of sequence clusters and singlets, where clusters can contain one or more contigs (where sequences within clusters have been successfully assembled) and/or associated singlets. The PTA transcriptview function supports a variety of different graphical displays for subsequent sequence analysis, and this contig-viewing tool was used for manual detection of SNPs.

SNP Detection: Manual Identification
Alignments containing at least 5 reads were visually scanned for putative SNPs, with basecalls in the region of interest confirmed by viewing each sequence trace. SNPs identified were grouped into two categories: "predicted frequent" SNPs were defined as those with a minimum of two independent sequence reads representing the minor allele, whereas "predicted rare" SNPs were those where the minor allele was represented by a single sequence read. The "predicted rare" category of SNPs is more likely to represent artifacts caused by errors in PCR amplification.

SNP Detection: Automatic Identification
The automated process for SNP identification used PolyPhred, which requires Ace-format files as input (Nickerson et al., 1997). Although PTA produces output in the form of Ace files, these proved to be incompatible with PolyPhred. Thus, each PTA contig containing 4 or more reads was processed via a pipeline using both Phrap and PolyPhred. Output files for each contig generated by PolyPhred were parsed using a custom perl script to extract information regarding contig coverage, predicted SNPs, and the proportion of contributing sequences harboring each sequence variant. Again, SNPs were grouped into "predicted frequent" and "predicted rare" categories, based on the minor allele frequency, with a small subset of the "predicted frequent" group selected for further analysis.

SNP validation: Primer Design and Generation of PCR Amplicons
A small subset of SNPs identified by both methods were selected for further validation. Genomic DNA was extracted from fin clip samples by Proteinase K lysis, followed by high-speed centrifugation, and eluted in a low-salt buffer (DNeasy® Blood and Tissue Kit, Qiagen). DNA was quantified spectrophotometrically using a NanoDrop (NanoDrop Technologies). Regions of cod genomic DNA containing SNPs of interest were amplified using the polymerase chain reaction (PCR). Flanking primers for SNP amplification were designed using Primer 3 (Rozen and Skaletsky, 2000). The primers selected were between 18-22 nucleotides in length with a G+C content ranging from 45-55%. Each DNA sample (20 ng) was amplified in the following 20 ml reaction: 0.4 U Phusion taq polymerase (Finnzymes, New England Biolabs), 800 mM dNTPs (GE Healthcare), 0.5 mM forward 5' primer, 0.5 mM reverse 3' primer and 1×HF Phusion buffer (Finnzymes, New England Biolabs). Each sample was denatured for 30 seconds at 98° C., cycled 35 times at 98° C. (10 sec), 63° C. (20 sec), 72° C. (20 sec) with a final extension at 72° C. for 4 minutes. Amplified samples were confirmed by gel electrophoresis (1% agarose in 1×TBE, 100V for 90 minutes) and purified using both 10 U of exonuclease I (New England Biolabs) and 2 U of shrimp alkaline phosphatase (SAP) (MBI Fermentas) with incubation at 15 minutes at 37° C. followed by 85° C. for 15 minutes. For high throughput preparation and analysis, multiple samples were amplified and purified in 96 well PCR plates (Axygen).

SNP Genotyping

The purified PCR products were used as the template in a single-base extension reaction with fluorescent dye labeled terminators and an unlabeled locus interrogation primer using the GenomeLab™ SNPStart Primer Extension Kit (Beckman Coulter). The interrogation primer was designed with its 3' end immediately upstream from a predicted SNP. In most cases, the interrogation primer was 30 bp in length, with a G+C composition of around 50+/−10% and a $T_m$ of approximately 60° C. Seven interrogation primers have a different size, ranging from 36 bp to 52 bp to test multiplexing. Samples were cycled 25 times at 90° C. for 10 s, followed by 45° C. for 20 s. The resulting reaction was purified using 0.25 U SAP (MBI Fermentas) with incubation at 37° C. for 30 minutes followed by 65° C. for 15 minutes. Samples were resuspended in formamide together with 0.5 ml GenomeLab™ DNA Size Standard 80 (Beckman Coulter) and separated electrokinetically using a Beckman CEQ 8000 capillary sequencer (Beckman Coulter). The resulting primer peaks were then analysed to determine the identity of the fluorescently-labeled single-base extension, and the resulting genotype called either automatically or manually.

Genotyping of Parents and F1 Progeny

SNPs, detected either manually or automatically, were initially validated and assessed for variability using genomic DNA extracted from adult Atlantic cod fin clips. These fin clips were taken from individual fish enrolled as parents in the two Cod Genome Project (CGP) selective breeding programs in New Brunswick (NB) and Newfoundland (NL). F1 progeny generated from crosses using these adult fish were also available within the breeding programs, and were used in further analysis involving the segregation of variable SNPs.

SNPs were first tested on genomic DNA isolated from two adult Atlantic cod parents in the NB program to ensure the successful amplification of the template PCR product and a successful primer extension step. Putative SNPs which passed this initial screening were then assessed for genetic variability using a parent panel of 22 wild broodstock fish. This parent panel comprised 8 adult fish from NL and 14 fish from NB. Mendelian segregation was then tested using 46 F1 progeny from each of 3 families generated by CGP breeding projects. Genotypes were analysed using the Microsatellite Microsoft excel package (Park, 2001). Allelic frequency, allelic absolute values and observed heterozygosity have been calculated for both NB and NL populations, and in total. Departures from Mendelian segregation have been tested in 46 progeny from at least one of the three families created by the CGP breeding project. Segregation at each locus was tested using the $c^2$ test, with the significance of the individual tests adjusted for multiple testing as shown in Table 3 (Bonferroni correction; Rice (1989)). The adjustment for multiple testing was performed within types of segregation, depending on whether crosses were of the type homozygous×heterozygous or heterozygous×heterozygous.

Analysis of Synonymous/Non-Synonymous SNPs

Each contig consensus was compared against the NCBI protein database using BLASTX (Altschul et al., 1977). SNP positions which fell within regions of similarity were noted, together with the corresponding reading frame and strand. The EMBOSS utility transeq, together with coordinates defining the appropriate region, strand and frame information, was then used to translate the consensus sequence for each version of a SNP. The resulting amino acid sequences were then compared to determine whether the SNP was synonymous or non-synonymous.

Sequence Annotation

For sequences where SNPs were detected, contig consensus was processed using autoFACT (Koski et al., 2005) using default parameters. Databases used in autoFACT analysis included UniProt's UniRef90, NCBI's nr, KEGG, COG, PFAM, LSU and SSU BLAST. Only BLAST hits with a bit score higher than 40 were considered significant.

Results

Manual Detection of SNPs Using PTA

Initially, few contigs had enough depth of coverage to allow identification of SNPs defined as "predicted frequent". Manual scanning of a small number of these contigs was performed to identify potential SNPs, which were used to develop a low throughput SNP validation pipeline. Using the PTA transcriptview tool, 115 putative SNPs were manually identified from a randomly-selected set of contigs with 5 or more contributing sequences. The Applicants selected a small set of SNPs, principally based on the primers design possibilities. Most of the SNPs in the manually-curated set were detected in contigs having 6-10 component sequences, with an average of 8.25 sequences For "frequent SNPs", the minor allele was observed in at least in two reads but the number of sequences in which the major allele was observed varied from 5-12 (50% to 81.1%).

A total of 30 putative SNPs identified using PTA were selected for validation (Table 1). Initially DNA samples from two NB parents were used for assay development. Of these, one failed to amplify in the first stage of testing. A further 5 failed at the primer extension stage, so in total, assays for 24 of these SNP were successfully developed. These 24 SNPs were then assayed to test their variability on a panel consisting of 14 parental fish from the NB breeding program and eight from the NL breeding program (Table 2). Twenty-one SNPs appeared to be polymorphic with the two predicted alleles detected within the set of individuals tested, and three were monomorphic. SNPs were generally polymorphic in both populations, with values for observed heterozygosity ranging from 0.14 to 1.0 in NB, 0.12 to 1.0 in NL and 0.14 to 1.0 overall (Table 2). These data show that SNPs could be selected within the CGP EST data which were highly variable in both of the populations used for family generation within the broodstock programs.

Automated SNP Detection Using PolyPhred

Manual prediction of SNPs was carried out at an early stage of sequence generation within the project. As additional sequences were generated and incorporated into sequence clusters, more contigs were produced with sufficient depth of coverage for detection of "predicted frequent" SNPs and a manual approach becomes untenable. The Applicants developed an automated pipeline using the sequence variation detection tool PolyPhred (Nickerson et al., 1997), which was first used to analyse the output from early stage clustering. A small subset of the SNPs generated by PolyPhred using the SNP validation process (Table 1), were tested and the automated output was analyzed to determine whether the SNPs identified by manual annotation were also detected by the automated process.

Initially 10 SNPs selected from the automated pipeline were tested, with a further seven SNPs added to the analysis where the interrogation primers were synthesized at different lengths to allow multiplexing of the genotyping reaction. The SNPs were selected based on the possibilities of primer design. Of the 17 SNPs tested, two failed at the first amplification step. Additionally, two of the amplification products exceeded the recommended length in the genotyping reaction, presumably because the amplification product included a large intron (or multiple introns) present in the genomic DNA template but not in the original EST sequence. A further four assays failed at the primer extension stage. However, all of the remaining nine predicted SNPs tested as polymorphic against the panel of 22 parental fish (Table 2).

Comparison Between PTA and PolyPhred SNP Identification Methods

The SNPs detected manually using Paracel Transcript Assembler (PTA) software were compared with SNPs detected automatically using PolyPhred (PP) software, to determine whether the automated pipeline was successful in detecting SNPs that would have been called by a manual annotator. The consensus sequences of the equivalent SNP-containing contigs selected from both PTA and PP were aligned using clustalW (Thompson et al., 1994). For both pipelines, the location of the SNP, the number of contributing reads and the allele ratio were confirmed. The success of the automated pipeline in identifying the same SNPs as the manual pipeline was assessed using two sets of criteria. When using the more stringent criteria in PP (allele ratio 30:70; at least four contributing reads), 11 of the 30 manually-annotated SNPs were not detected. However, this number decreased to six when using less stringent criteria (allele ratio 25:75; at least four contributing reads).

Only two of the six manually-annotated SNPs which were not detected by the automated pipeline were successfully validated experimentally (PTA_179.c1 and PTA_153.c1). These SNPs were not identified by the automated pipeline because they fell out of the criteria range since PP eliminated some sequences based on quality criteria. The remaining four SNPs were not identified automatically for several reasons. Two failed on sequence quality criteria (PTA_056.c1, PTA_463.c2), one failed because the PP pipeline generated a contig which did not successfully align with that produced by PTA (PTA_263.C1), and one failed because the minor allele was only represented by one sequence (PTA_079.C1) in the automated assembly.

The Applicants also tested a small number of "rare SNPs" (3) selected from both the manual and the automated pipelines to determine their utility (minor alleles comprising less than 25% of the sequences), for example, PTA_079.C1, PP_161.C1 and PP_134.C1. None of the "predicted rare" SNPs gave good results, although a very small number were analysed. When tested on the parent panel, PTA_079.C1 was monomorphic in all fish tested, with PP_134.C1 and PP_161.C1 appearing to represent gene duplications.

SNP Analysis

Almost all PCR primers (42/47) amplified a product, except for those primers for SNPs PTA_263.C1, PP1062.C1, PP1159.C1, PP1301.C1 and PP127.C1 (Table 1) which did not generate products. When tested on a panel of 22 wild fish, the 33 SNPs shown in Table 2 gave a good primer extension assay. Thirty of the SNPs tested appeared to show polymorphism in the 22 wild fish tested, with a further three SNPs being monomorphic in the small number of individuals assayed. The experimentally detected alleles agreed with those predicted in all cases. Allelic frequencies were compared using a $c^2$ test to see if there was a variation between populations. Overall, no significant differences were observed between the NB and NL populations. SNPs predicted using either method appeared highly variable in both populations (Table 2).

Family Informativeness

SNPs are less informative for linkage mapping because they are almost always biallelic. The 22 wild fish tested to assess SNP variability had been used to create 13 cod families within the CGP breeding programs. These families were assessed to select a small number of crosses in which to assess SNP segregation patterns. The number of informative loci for these 13 families ranged from 25% to 60%, with an average of 42.2%. For the 30 polymorphic SNPs identified, it was necessary to test only three of these families to have informative loci to be tested for linkage analysis.

Of the 30 SNPs tested for their patterns of inheritance, one SNP (PTA_1522.c1) was only tested on a small number of progeny since both parents were homozygous with a different allele, so the resulting progeny are all heterozygous and therefore segregation could not be tested. However, this SNP was inherited as expected. For the remaining 29 SNPs, 22 showed Mendelian inheritance patterns. Of these, four showed a distortion of segregation (PP_1657.C1, PTA_657.c2, PTA_179.c1, PTA_912.c1), but when correcting for multiple tests, none remained significantly different. In order to get genotypes usable to mapping purposes, it is necessary to have one homozygote and one heterozygote for each SNP as parents in a cross. Only these 22 SNPs (out of the 33 successful assays) are suitable for placement on a map using these three families i.e. they are present as homozygote/heterozygote in one of the three crosses tested, and they show correct Mendelian segregation (Table 3).

A further seven SNPs amplified correctly in the parent panel, but when testing allelic segregation in the progeny the parental alleles did not segregate as expected. One SNP, PP_134.C1, is likely to represent gene duplication, or two very similar members of a gene family, rather than different alleles of the same gene, since both parents and their progeny appear to be heterozygotes. A further SNP, PP_161.C1, also appears to result from a gene duplication as three variants were observed, with inheritance patterns suggesting two genes, with one being homozygous (G) and a second having two alleles (C/T). For this SNP, both parents and progeny can be scored as having three genotypes for this SNP in a single individual (G, C and T).

For the other five SNPs no clear pattern to the irregular segregation observed could be discerned, and these "SNPs" may in fact represent evidence of copy number variants, which have recently been identified as occurring frequently in the human genome (Redon et al., 2006). For these 5 SNPs a significant variation in signal strength was also observed for each allele, making scoring difficult, and indicating that there may be underlying copy number changes.

Annotation of Contigs Containing SNPs

Contigs containing each of the SNPs tested were compared with 9 databases, including UniProt's UniRef90, NCBI's nr, KEGG, COG, PFAM, LSU and SSU BLAST with the results analysed using autoFACT. Out of the 23 polymorphic SNPs with Mendelian inheritance patterns and the three monomorphic SNPs, 14 had a significant hit with cutoff BLAST score>40 (Table 4). The Applicants also used BLAST to determine if these SNPs resulted in synonymous or non synonymous amino acid substitutions (Table 5). This could only be determined for four SNPs, with the remaining SNPs either located in non-coding regions (9) or showing no similarity within the databases searched (13). Of the four SNPs present in the coding region, two were synonymous (PTA_1153.C1; PTA_1473.C1) and two were non synonymous (PTA_1090.C1; PTA_624.C1).

Discussion

The Applicant developed both a low throughput (manual) and a high throughput (automated) SNP identification pipeline, together with a set of experimental SNP validation methods in order to validate SNPs detected within cod EST contigs generated using an automated pipeline. As shown in Table 2, for the 47 SNPs tested, 70% (33) amplified correctly and gave a successful primer extension, on a small panel of 22 wild fish. However, when testing for segregation, unusual, non-Mendelian patterns of segregation were observed for 15% (7) of the SNPs tested (Table 3). This Example shows the importance of validating markers for Mendelian segregation. It is possible that these putative SNPs actually represent copy number variants residing on duplicated genome segments. These anomalous SNPs can be identified by analyzing patterns of segregation (Gut and Lathrop, 2004) with, in obvious cases, all progeny appearing heterozygous, but in other cases an excess of heterozygotes is observed, as seen in salmon (Hayes et al., 2007). From the segregation study, we estimated that 15% of putative SNPs are likely to represent gene duplications, which is similar to than in salmon where 14% of putative SNPs have been identified as being located in duplicated regions (Hayes et al., 2007), but much higher than that observed by Moen et al. (2008) who predicted that 2% of SNPs represent duplicated genes. These discrepancies may indicate differences in the clustering parameters used between different groups, and will be resolved on analysis of a larger SNP set.

The criteria used in the present application for SNP identification is biased against the detection of rare SNPs. It was necessary to select SNPs from contigs with a large number of contributing sequence reads to reduce the likelihood that putative SNPs represent artifacts arising from errors in amplification or sequencing. Each different SNP version is required to be represented by a minimum of two confirmatory reads.

It is also important to know if SNPs identified in coding sequence are synonymous/non-synonymous as non-synonymous substitutions will alter the amino acid composition of the resulting protein.

Large-scale SNP discovery is a first step towards developing a dense genetic map for Atlantic cod. Developing SNPs from ESTs is of particular value, since all should be associated with transcribed genes, and can therefore be used to anchor comparative genomic analyses.

The present disclosure presents and validates a set of SNP markers for Atlantic cod. The low throughput study for SNP described here validated manual and automated SNP detection, and estimated genetic variability and segregation. These SNPs represent a valuable resource for genetic mapping and QTL analysis, but also for genetic studies in wild populations of Atlantic cod.

Example 2

Development of a SNP Resource and a Genetic Linkage Map for Atlantic Cod

Background

Information provided for this example is also described in Hubert et al. 2010. With wild Atlantic cod (*Gadus morhua*) stocks declining dramatically over the last few decades (Rose, 2007), aquaculture is becoming increasingly important as a means of maintaining a market supply for this species. Cod aquaculture is currently being developed in several countries (Rosenlund et al., 2006), but has not yet reached a sustainable commercial scale (Brown et al., 2003). Applying genomics tools in the selection of elite broodstock has the potential to enhance the productivity and value of commercial production for this species (Gjedrem, 2000).

Genetic marker discovery is a necessary first step in the application of genomics to improve broodstock as these markers can be used for the creation of linkage maps and subsequent QTL identification. Marker assisted selection (MAS) can then be employed by selecting broodstock based on genotypes at QTL that are relevant to economically important traits such as rapid growth, disease resistance and the control of early maturation. Currently, a limited collection of genetic markers is available for Atlantic cod, including restriction fragment length polymorphisms (RFLP), microsatellites and single nucleotide polymorphisms (SNPs) (Pogson et al., 1995; Delghandi et al., 2008a; Delghandi et al., 2008b; and Higgins et al., 2009). Most of the studies describing genetic markers in Atlantic cod have employed microsatellite markers (Wesmajervi et al., 2007; Ruzzante, 1996). In total, 352 microsatellites have been published to date for this species, including a large, new collection of expressed sequence tag (EST) derived microsatellites (Higgins et al., 2009). However, SNPs are the most abundant type of DNA sequence polymorphism, are suitable for high-throughput genotyping, and provide enhanced possibilities for genetic and breeding applications, linkage map development, assessment of genetic variability and marker assisted breeding. As a result, SNP discovery pipelines have been recently developed for many species including fishes (Hayes et al., 2007; Cenadelli et al., 2007; He et al., 2003; Stickney et al., 2002; and Ryynanen et al., 2006). To date, a collection of 318 SNPs has been identified for Atlantic cod using 17,056 ESTs generated from a North-East Atlantic cod population, and these SNPs have been tested on several additional Norwegian cod populations (Moen et al., 2008). In total, 174 of these SNPs, together with 33 microsatellites, have been used to generate a genetic linkage map for Atlantic cod. This map comprises 25 linkage groups with an overall length of 1225 cM, and represents the first reported linkage map for this species (Moen et al., 2009).

As set out in Example 1, SNPs have been identified from sequence data generated by a large-scale expressed sequence tag (EST) program focusing on fish originating from Canadian waters. A subset (3072) of these SNPs (listed in Table 6) have been tested for polymorphism across a number of different wild stocks and has also been used to generate a preliminary linkage map for this species. The EST set was designed to provide an excellent resource for SNP marker discovery, since it is generated from several cDNA libraries representing different tissues, with three to 340 individuals contributing to each library. Furthermore, many of the SNPs developed were identified from sequence data with functional annotation potentially allowing the identification of genes contributing directly to a phenotype.

Putative SNPs identified in this study were subsequently validated for polymorphism across a number of geographically diverse Atlantic cod populations, ranging from Canada to the North-East Atlantic (Iceland, Norway and Ireland). These SNPs were also tested for Mendelian segregation in two families, and used to create a high-density genetic linkage map that can be applied in QTL analysis to facilitate cod broodstock selection.

Materials and Methods

Validation of Putative SNPs on Panel

In total, 5×96 well plates of selected DNA samples were genotyped using the two Illumina GoldenGate panels. Two plates consisted of two references families, B33 and B87 with two parents and 91 progeny. The three remaining plates consisted of wild cod populations. In total, seven populations of Atlantic cod were genotyped for this study, with an average of 23 fish genotyped per population. The geographic location of collections covers the North Atlantic with a more detailed sampling for Atlantic Canadian populations. DNA extraction methods have been described previously. In summary, fin clips or muscle tissue samples were taken and placed in 95% ethanol. DNA was extracted using the Qiagen DNAeasy 96 extraction kit (Qiagen, Mississauga, ON). The kit protocol utilizes a buffer containing proteinase K to lyse the tissue. The lysate is loaded onto a plate where the DNA binds to a silica membrane in the presence of chaotropic salt. Proteins and other contaminants are washed from the bound DNA using wash buffers and centrifugation. DNA is then eluted in water. High-throughput genotyping was performed using the GoldenGate assay.

SNP Annotation

For sequences where SNPs were detected, the consensus sequence for each contig was compared to the NCBI nr database using BLASTX (Altschul et al., 1990), with a value of $1 \times e^{-05}$ used as the cutoff to determine significance. All SNPs that were determined to be polymorphic after testing have been deposited in the GenBank SNP database under accession numbers ss131570222 to ss131571915. Sequences, and their associated annotation using both BLASTX and AutoFACT (Koski et al., 2005), can also be accessed via the CGP database (http://ri.imb.nrc.ca/codgene).

Identification of Synonymous and Non-Synonymous SNPs

The procedure for determining a SNP as synonymous or non-synonymous is as outlined in Example 1. Briefly, each contig consensus was compared against the NCBI protein database using BLASTX to establish a reading frame in which to assess synonymous or non-synonymous status. For those SNPs within regions of similarity, the consensus sequence was translated for each SNP allele and the resulting amino acid sequences were then compared to determine whether the SNP was synonymous or non-synonymous.

Analysis of Atlantic Cod Populations

Loci deviating from Hardy-Weinberg equilibrium (HWE) were identified in each of four Canadian populations of Atlantic cod. This was assessed separately in each population using Hardy-Weinberg exact tests calculated using GenePop v4.0 (Rousset, 2008). The 64 loci that failed Hardy-Weinberg exact tests in four Canadian populations were excluded from data used to generate the linkage map.

Genetic Linkage Map Construction

The genetic linkage map was constructed using JoinMap®4. Genotypes for progeny generated through the Illumina GoldenGate platform were converted to CP codes based on parental genotypes. Each cross was examined separately, with segregation ratios analysed for all loci, and those which showed abnormal segregation as determined using a chi-square goodness of fit test were removed (P<0.005). Markers were then associated within linkage groups using the group function of JoinMap®4, using a LOD cut-off value of 5.0 or greater. Marker orders within linkage groups were determined and map distances calculated using Haldane's mapping function. Maps generated independently for the two families were compared, and a 1:1 correspondence between linkage groups confirmed. The corresponding groups from the two families were combined using the JoinMap®4 merge function, and a consensus map generated.

Results

SUMMARY

Figure 5:
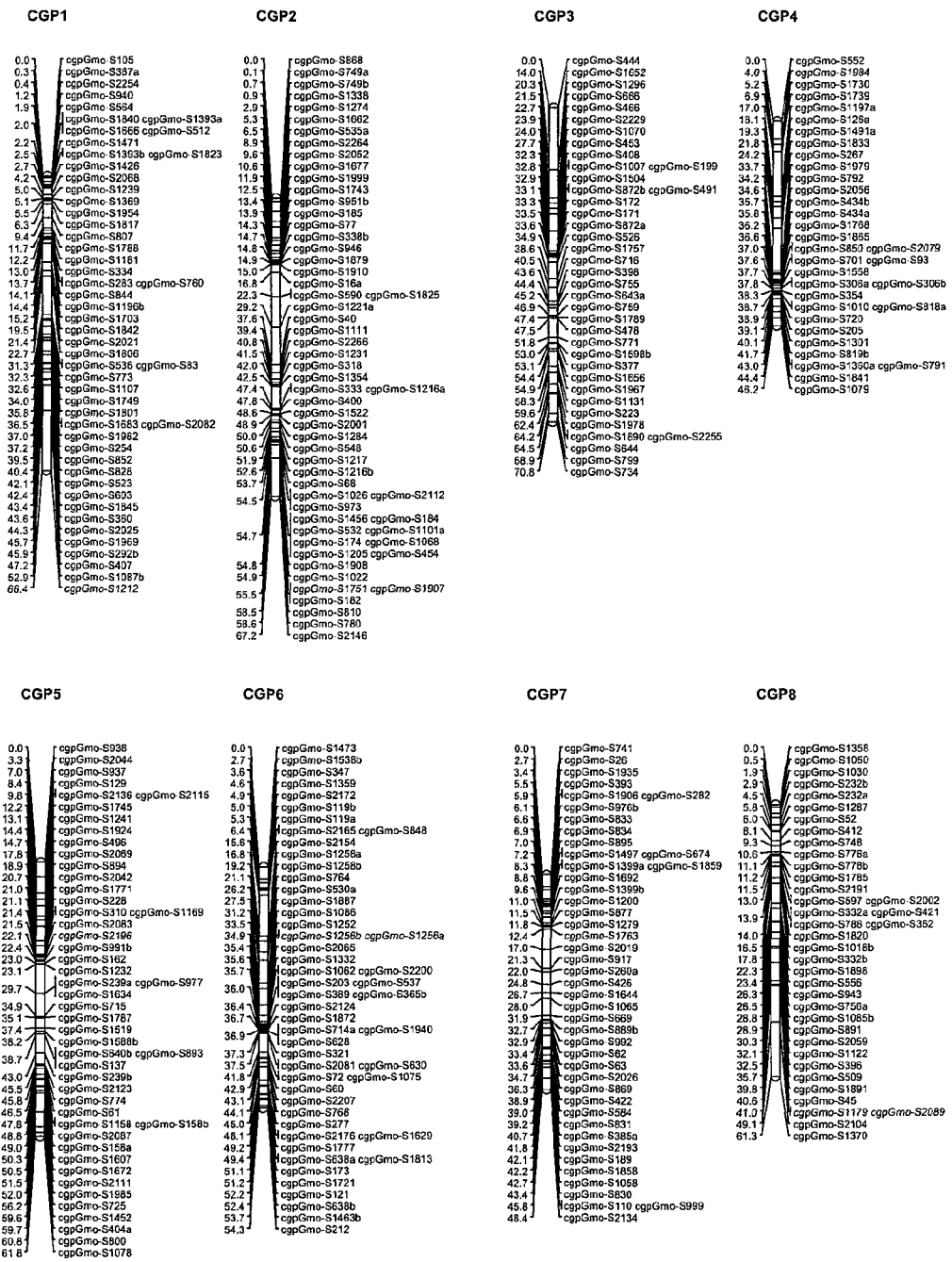
FIG. 5 is a genetic linkage map for Atlantic cod. The 23 major linkage groups are shown. These have been arbitrarily numbered CGP1-23 based on the order generated by JoinMap[4], and to distinguish them from the linkage groups generated by Moen and colleagues (Moen, 2009). Distances in centimorgans are indicated on the left of each linkage group, with SNP identifiers on the right. A revised version of the genetic linkage map used for QTL analyses is provided in Table 10.

A total of 97976 ESTs were assembled to generate 13448 contigs. 4753 SNPs were detected that met our selection criteria, which included a depth of coverage of at least 4 reads with a minor allele frequency higher than 25%. From the 4753 SNPs identified, the 3072 SNPs listed in Table 6 were selected for testing using two Illumina GoldenGate panels. The percentage of successful assays was 75% for these panels, with 2291 SNPs amplifying correctly. From the successful assays, 607 (26%) of the SNPs were found to be monomorphic for all populations tested. In total, 64 (4%) of SNP assays that scored as polymorphic are likely to represent duplicated genes or highly similar members of gene families, rather than alternative alleles of the same gene, since they showed a high frequency of heterozygosity in the samples tested. The remaining polymorphic SNPs (1620) were categorised as validated SNPs and are also identified in Table 6. The mean minor allele frequency among the validated loci was 0.258 (+−0.141). The ratio of transition to transversion types of substitution was 1.11:1 for validated SNPs. Of the 1514 contigs from which validated SNPs were selected, 31% have a significant blast hit. Of the 141 of these SNPs that are predicted to occur in coding regions, we determined that 64% (90) are synonymous. When comparing different populations, including those from North America and Europe, a large number of loci (1033 SNPs; 64%) are polymorphic for all populations originating from the North Atlantic. However a small number of SNPs (184), shown in Table 11 that were shown to be polymorphic in the Western Atlantic were monomorphic in all fish tested from three European populations. The large set of validated, polymorphic SNPs has been used to construct a preliminary linkage map using two families, with two parents and 91 progeny genotyped in each case (FIG. 5). This map has 23 major linkage groups and 924 mapped SNPs.

In addition, a set of associated SNPs was also found to distinguish some Northern and Southern populations of cod. It was noted that linkage group 7 (Table 10) had characteristics that can be associated with low recombination. A set of 21 SNPs (identified on 20 contigs) were found to co-segregate on the linkage map. This was the largest set of co-segregating SNPs on the linkage map. Genotypes for different individuals included in the population analysis were obtained. Individuals from the most extreme populations, Norway and Ireland, were used to identify the "North" and the "South" genotype respectively. Then genotypes for other populations were identified using homozygotes with North or South-type genotypes (Table 12). For the Canadian population tested, it is noteworthy that fish from populations near New Brunswick harboured the South and the North-type genotype, but fish from populations near Newfoundland harboured only the north-type genotype for all fish tested.

Validation of Putative SNPs on Panel

Out of the pool of 4753 predicted good quality SNPs, 3677 SNPs satisfied the criteria for the Illumina Golden Gate platform in that they appeared to be bi-allelic, with 100 bp of flanking sequence and less than 60 bp from a selected neighbouring SNP, and these SNPs were scored for primer design. Two Golden Gate panels, each comprising 1536 SNPs (3072 SNPs total; listed in Table 6), were created from the best-scoring SNPs (CGP Panel 1 and CGP Panel 2) and these were tested against a large number of Atlantic cod sampled from a number of sites (multiple populations from Canada, and single collections from Iceland, Ireland and Norway). Parents and progeny from two reference families selected from the CGP breeding program in New Brunswick were also genotyped to test for non-Mendelian segregation and for the creation of a genetic linkage map (Table 9).

Figure 2:
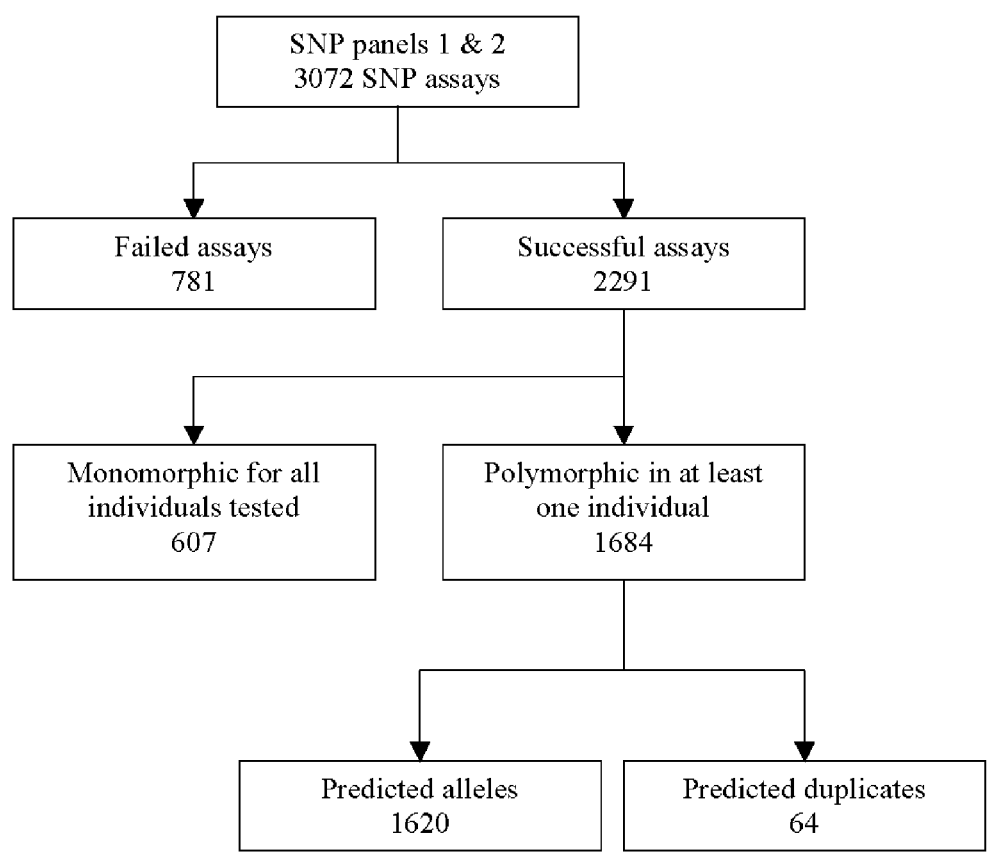
FIG. 2 is a flowchart showing the output resulting from testing of the 3072 selected SNPs. The 1620 "predicted alleles" correspond to the set of validated SNPs.
Figure 3:
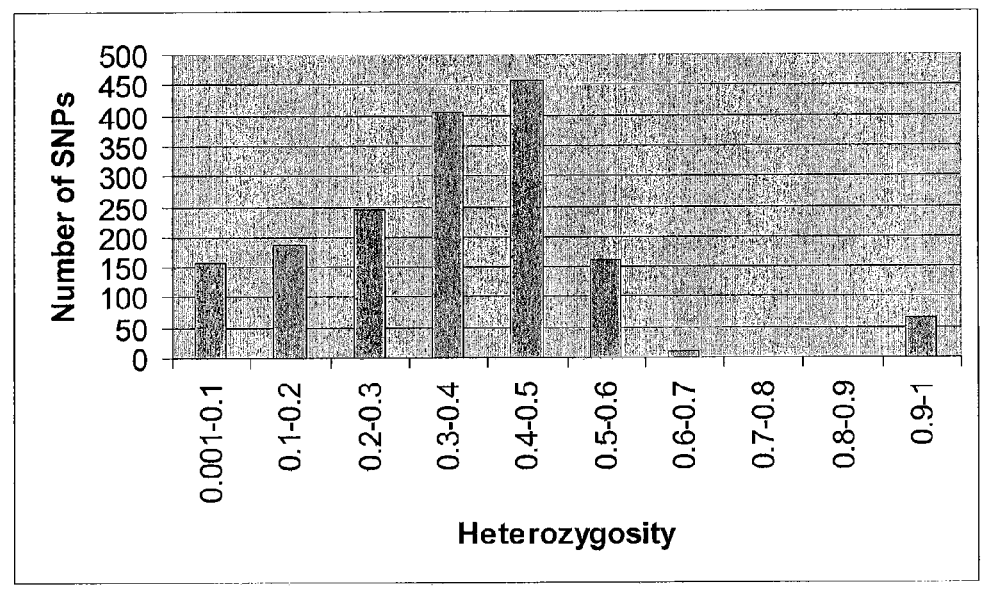
FIG. 3 shows the observed heterozygosity for polymorphic SNPs in four Canadian populations. SNPs were grouped into categories based on their values for observed heterozygosity averaged across four Canadian populations. All polymorphic SNPs were analysed, including those with high values for observed heterozygosity (predicted duplicates). The number of SNPs falling into each category is shown.
Figure 4:
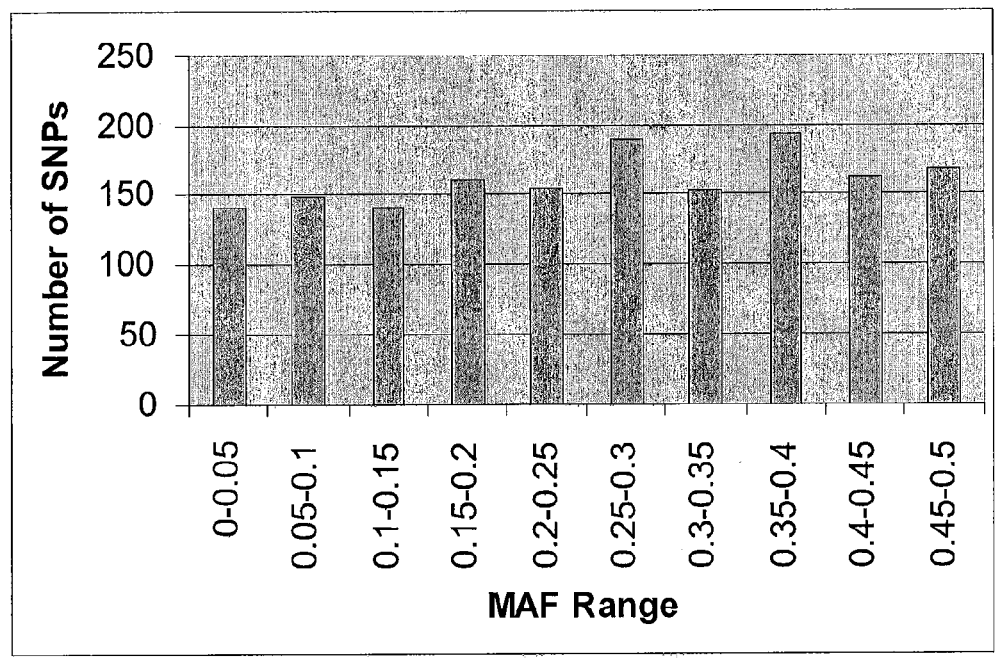
FIG. 4 shows the minor allele frequency of validated SNPs in four Canadian populations. SNPs were grouped into categories based on their minor allele frequency (MAF) averaged across four Canadian populations. Only the validated SNPs have been included in this analysis, with the number of SNPs falling into each MAF category shown.

The success rate for SNP assays was 75% for the two panels tested, with a total of 781 assays that failed to give good quality genotypes (FIG. 2). From the 2291 successful assays, 607 SNPs (26%) were monomorphic (i.e. only one SNP variant was identified) in all individuals from four Canadian populations that were tested (Table 8), and therefore are either incorrectly identified as SNPs, or are rare SNPs within the populations analysed. The majority of these have a minor allele represented by two sequences, the minimum allowed by our selection criteria; only a small number of monomorphic SNPs have more than 2 reads representing the minor allele. In total, 1684 SNP assays identified both SNP variants, with at least one individual tested carrying the predicted minor allele. However, 64 of these SNPs showed a high proportion of heterozygotes in all individuals tested (FIG. 3), indicating that they might represent sequence variation between duplicated genes, or members of closely related gene families, rather than different alleles from the same gene; the total number of SNPs predicted as corresponding to bi-allelic loci was 1620 (FIG. 2; identified in Table 6). For the purpose of this study, we define validated SNPs as those having a value for observed heterozygosity greater than zero but lower than 0.9. Therefore this study has identified 1684 polymorphic SNPs, with 1620 of these being validated SNPs as we predict they correspond to a base change at a single locus. The average observed heterozygosity for these validated SNPs was 0.332 (+/−0.148) and ranged from 0.01 to 0.69. The mean minor allele frequency among the validated SNPs was 0.258 (+/−0.141) and ranged from 0.005 to 0.5. The number of SNPs observed with varying MAFs in the four Canadian populations enrolled in the CGP breeding programs is shown in FIG. 4. The number of SNPs in different MAF ranges from 0.05 to 0.5 is relatively consistent for these populations, with 141 validated SNPs having a MAF lower than 0.05, and 169 SNPs with a MAF from 0.45 to 0.5 for example.

SNPs for CGP panel 1 (1536 SNPs) were chosen such that only one SNP per contig was included. The second panel selection consisted of various categories of SNPs chosen based on a prioritized strategy. Initially, SNPs from remaining contigs not represented on the first panel were selected. The panel was then completed by selecting SNPs that are neighbours on the same contig to SNPs that failed, or were monomorphic, on panel 1, and also SNPs that are neighbours to successful SNPs on panel 1 (or a small number of SNPs included on panel 2 which had not yet been tested) but having a different haplotype. A few SNPs were selected manually based on contig annotations, with some of these identified on SSH EST contigs. Thus the final set of validated SNPs (1620) were selected from 1514 contigs, with several contigs having multiple validated SNPs. These can be identified in the SNP set as they have an identical number, but a different suffix, as in cgpGmo-S177a and S177b for example.

SNPs neighbouring failed panel 1 SNPs had slightly lower success rate (69%) when compared to other SNP categories, which ranged from 72 to 79%. Analysis of the polymorphism of successful panel 2 SNPs showed that SNPs neighbouring panel 1 failures have a higher number of polymorphic SNPs (78%) when compared to the "unique SNPs/contig" category (71%). Two categories showing the smallest number of polymorphic loci are the manually picked SNPs (35%) and the neighbours of monomorphic panel 1 SNPs (47%). Some of the manually picked SNPs were selected from SSH libraries which had each been generated from a single family, and thus this subset may contain a greater proportion of SNPs which are rare within the population as a whole.

The ratio of transition substitutions (A/G and C/T) to transversions among predicted alleles of the 3072 putative SNPs chosen for inclusion on the two Illumina panels was examined. The base substitution frequency was compared with that seen in the validated SNPs. Little variation was found between the ratio of transition:transversion substitution types for the different SNP categories (putative SNPs and validated SNPs), with a ratio of 1.18:1 for the SNPs selected for validation, which decreased slightly to 1.11:1 for validated SNPs (Table 10).

Functional Annotation of SNPs

The SNPs described herein are particularly valuable as they are linked to expressed sequences. However, because a large fraction of the 3' sequence in which the SNPs were detected is likely to originate from the 3' UTR of each transcript, most SNPs were expected to fall in non-coding regions. This resulted in a relatively low percentage of sequences for which a function could be inferred based on sequence similarity. Of the 1514 contigs from which at least one validated SNP was selected, 474 (31%) had a significant blast hit (e value$<=1e^{-05}$) in the NCBI non-redundant dataset. In total, 514 SNPs (32%) were associated with sequences having significant similarity to an entry in the NCBI nr database.

After analysis based on sequence homology, a subset of the SNPs identified was found to fall within coding regions; these SNPs were analysed to determine if substitutions encoded by the two allelic variants would result in an amino acid change, i.e., if the substitutions are non-synonymous or synonymous. Only 9% of validated SNPs occur on a known reading frame within coding regions (i.e. they have similarity with a protein sequence present in public databanks). Of these 141 SNPs, 90 (64%) were predicted to generate synonymous substitutions, while 51 (36%) were non synonymous.

Population Comparison

Provided herein is a description of SNP characteristics in several populations of Atlantic cod shown in Table 9. From our analysis, the number of monomorphic loci varied greatly between the Canadian populations and more distant populations such as Ireland and Norway. A large number of loci (1033) are polymorphic in all populations. As anticipated, the greatest number of monomorphic loci from this SNP set is seen in the East Atlantic populations (Iceland, Ireland and Norway). This is likely to be due to ascertainment bias rather than a real underlying difference in variability between West and East Atlantic populations, as SNPs were selected based on their frequent occurrence in Cape Sable and Bay Bulls fish. A number of SNPs (184; listed in Table 11) have been identified as diagnostic SNPs as they can be used to distinguish between Western and Eastern Atlantic cod populations, being monomorphic in fish tested from the Eastern Atlantic cod populations (Iceland, Ireland and Norway) but polymorphic in Western Atlantic cod populations. In addition, a set of associated SNPs were also identified that can be used to distinguish some Northern and Southern Atlantic populations (see Table 12).

A few of the polymorphic SNPs were not in Hardy Weinberg equilibrium (HWE) in one or more of the four Canadian populations tested. We determined that 65 of the total collection of polymorphic SNPs significantly deviate from HWE in all four populations ($P<=0.05$), and the vast majority of these (64) were screened out from the set of validated SNPs as they had values for observed heterozygosity greater than 0.9. An additional 136 SNPs show significant deviations from HWE in one population only, and this is also true for 19 SNPs in two of the four populations and two SNPs in three of the four populations tested.

Mendelian Inheritance and Informativeness of SNPs for Linkage Mapping

Segregation patterns of SNPs (Mendelian/non-Mendelian) were tested by genotyping the parents and progeny from 2 CGP families, to ensure that SNPs can be used reliably for linkage analysis. In each case, patterns of segregation were assessed in the 91 progeny genotyped for each family. Most of the SNPs that were predicted to represent differences between genes (paralogs or members of gene families) were removed prior to analysis of segregation patterns, although a small number were included in the initial analysis, and all of these demonstrated non-Mendelian inheritance patterns. Additional SNPs also showing non-Mendelian inheritance were screened out prior to generating the linkage groups used for map generation. Different, overlapping sets of SNPs could be assessed for segregation in each of the two families. In family B33 it was possible to examine the inheritance for 858 SNPs, whereas 832 SNPs were informative in family B87. A total of 19 SNPs in family B33 showed a significant departure from Mendelian segregation ($P<=0.005$) however nine of these are predicted to represent gene duplications/multigene families rather than real SNPs since both parents and all progeny are heterozygous. For family B87, 38 SNPs showed significant departure from the Mendelian expectation, with 12 SNPs predicted to arise from duplications rather than segregating alleles in this family. Combining the results from the two families, a total of 46 SNPs show non-Mendelian segregation, with 14 of these giving results indicative of gene duplication in at least one family.

On comparison, 64 of the 65 SNPs that deviate from HWE in all four of the Canadian populations tested in this study were either screened out as potential duplicates prior to analysis, or showed non Mendalian inheritance ($P<=0.005$) in one or both of those crosses. It was possible to map a single SNP, cgpGmo-S89a, from this category. Of the 157 SNPs that deviated from HWE in one, two or three Canadian populations, two failed the test for Mendelian segregation in both families used for mapping (cgpGmo-S1835 and S1962), with a further three SNPs showing departure from Mendelian segregation in family B33 but segregating correctly (within the parameters allowed for Mendelian inheritance) in B87 (cgpGmo-S1219b, S626a and S2232). However, the majority of the SNPs in this second category could be successfully placed on the linkage map.

Generation of a Preliminary Genetic Linkage Map for Atlantic Cod

The generation of genomics resources as described herein is tightly integrated with family-based selective breeding programs based in New Brunswick and Newfoundland. As part of these programs, individual crosses are generated with known parental contribution, with the progeny from these crosses reared in separate tanks until they reach a suitable size for surgical implantation of a passive integrated transponder tag. Parents and 91 progeny from each of two independent crosses, families B33 and B87, were genotyped using the two Illumina GoldenGate panels described in this study (Table 8) with the aim of generating a SNP-based genetic linkage map.

After removal of the loci with highly skewed segregation ratios ($P<0.005$) described earlier, JoinMap®4 (Van Ooijen, 2006) was used to generate linkage groups of associated loci for each family independently, and to order loci within linkage groups to create a preliminary map. For both families, 23 major linkage groups were generated using an LOD threshold value of 5.0, which is in good agreement with the haploid chromosome number of 23 usually reported for Atlantic cod (Fan et al., 1991). A small number of SNPs that failed to be assigned to these 23 linkage groups, as well as a few additional linkage groups generated by JoinMap®4 containing 2-3 loci, were not incorporated in further analyses. Marker content of linkage groups, and marker order within those groups, was in good agreement when the maps for the two families were compared. Therefore, the family maps were combined to generate a consensus map using the merge function of JoinMap®4. The consensus map produced is shown in FIG. 5, and contains 924 loci on 23 linkage groups, ranging from to 41 to 79.5 cM in length, and a total map length of 1421.92 cM. The number of markers per linkage group ranges from 23 to 58, with an average of 40.2.

Discussion

The present description provides a large collection of SNP markers suitable for the genetic analysis of cod. After screening 13448 contigs generated from 97976 ESTs, 4753 SNPs were identified using the criteria of 4 reads minimum and a MAF>25%. Assays have been developed for 3072 SNPs using 465 fish, which were genotyped using a GoldenGate assay. The success rate for this set of SNP assays was 75%. The SNPs were assessed for polymorphism by testing against Canadian and European populations and it was determined that 26% of SNPs were monomorphic. Table 6 lists the 3072 SNPs for which assays were developed, and also identifies the 1620 SNPs that were validated according to the present Example. However, on analysis, a small number of the SNPs were found to be identical to SNPs identified independently in a previous study (Moen et al., 2008). The SNPs of the present disclosure that overlap with those described by Moen et al. are listed in Table 13.

The frequency of the present set of selected SNPs in Atlantic cod is 1/516 bp, which is similar to the frequency reported in Atlantic salmon of 1/614 bp (Hayes et al., 2007). It is somewhat lower than the frequency observed in *Oncorhynchus keta* (chum salmon; 1/175 bp) or in *Oncorhynchus tshawytscha* (Chinook salmon; 1/301 bp) (Smith et al., 2005). SNP selection strategy is likely to play a large role in the observed frequency of SNPs within the genome, but it also might reflect the fact than in case of Atlantic cod and Atlantic salmon SNPs have been detected in fish originating from a limited number of populations.

To maximize the detection of real SNPs, stringent criteria were used to reduce the likelihood of selection of false or rare SNPs. It was postulated that selecting SNPs having the minor allele represented in at least two reads will generate a set of markers that are useful for gene mapping and parental assignment. However, the present SNP set has been selected based on SNPs that are expected to be frequent within populations being used for selective breeding in Atlantic Canada and in related populations located in the area surrounding Atlantic Canada. Therefore, this set of SNPs is likely to be less useful for the estimation of genetic variation in populations with different geographical distribution, such as populations originating in North-East Atlantic The present SNP collection likely contains few rare SNPs because of the selection criteria employed. These rare alleles can be useful for the analysis of certain populations since they may prove to be specific to, and thus diagnostic for, these populations. The fact that 184 SNPs were found that are polymorphic in Canadian populations but monomorphic in North-East Atlantic populations is a clear indication that, due to the ascertainment bias intrinsic within the selection procedure, the present collection of SNPs might be regarded as less useful resource for characterizing the genetic structure of European populations.

The ratio of transition (A/G, C/T) to transversion (interchange of purine for pyrimidine bases) substitutions among validated SNPs was 1.11:1. This is lower than the values obtained in Atlantic salmon, (1.37:1) (Hayes et al., 2007) and for *O. tshawystsha* (1.49:1) (Smith et al., 2005). These values are both slightly higher than that reported for zebrafish of 1.20:1 (Stickney et al., 2002). It was also observed that the ratio is slightly different between predicted SNPs and validated SNPs, which are 1.18:1 and 1.11:1 respectively, showing that the success rate of validation for transition substitutions is marginally lower.

The SNPs developed in the present study add significantly to the total number of validated SNPs for Atlantic cod. In a previous study, Moen and colleagues identified and validated 318 SNPs (Moen et al., 2008), however only 7 SNPs were common between the two studies and these have been listed previously in this section. The SNPs described in both analyses have been detected from EST assemblies and thus are associated with transcripts. One third of the SNPs were detected on annotated sequences in the present analysis as the ESTs on which they were detected have a high proportion of non-coding sequence, whereas in the Norwegian study 87% of the SNPs had a significant BLAST hit. Validation success was similar in both studies, with the percentage of failed assays at 29% for Moen et al. (Moen et al., 2008) and 25% for the present study. The number of polymorphic SNPs as a percentage of all putative SNPs tested was found to be 54% by Moen et al. (Moen et al., 2008) and 55% in the present study (53% for validated SNPs). The number of monomorphic loci was slightly higher in the present study than found by Moen et al. (Moen et al., 2008). The majority (91%) of predicted SNPs that were found to be monomorphic in the present study have their minor allele represented by 2 reads only. These likely fall into two categories; 1) SNPs that are rare within the populations tested, and therefore polymorphism at these loci exists but was not observed in the sample set tested, and 2) incorrect SNP predictions. This emphasizes the need for stringent selection criteria and also that validation of SNPs is a necessary step to establish the accuracy of markers.

The libraries from which the sequences used in the assembly were generated, and thus from which SNPs were identified, were created using tissue from fish originating from collections from Nova Scotia (Cape Sable) and Newfoundland (Bay Bulls), Canada. By testing these SNPs against more eastern populations such as Ireland, Iceland and Norway, we have shown that they are also informative as markers across more geographic distant populations. Some SNPs (184) were found to be polymorphic only in all Canadian populations, and therefore have the potential for use as traceability markers.

By genotyping, two reference families, SNP were checked for Mendelian segregation. A numbers of SNPs showed a significant departure from Mendelian segregation but in fact they were more likely paralogous genes coding for 2 SNPs since both parents and progeny were heterozygous. This is not uncommon when identifying SNPs in fish. In most studies around 2-4% of validated SNPs are assumed to be duplicated SNPs (Moen et al., 2008) except for salmon where 14% of SNPs were scored as heterozygotes in all individuals tested (Hayes et al., 2007). However, in addition to the set of SNPs predicted to occur on duplicated genome segments, several additional SNPs show non-Mendelian segregation patterns in the two families tested. Also, four SNP, two in family B33 and two in B87 appear to be duplicates in that family, but segregate in the other family, which could be indicative of either selective forces acting differently upon those families or, more likely, complex patterns of gene duplication and divergence.

Most of the SNPs described herein are predicted to fall within non-coding sequence. This is expected in the present dataset as all of the ESTs used in SNP identification were sequenced from the 3' direction, and thus the majority of each sequence is likely to represent the 3' untranslated region. Nevertheless, a minority of the SNPs identified herein are predicted to occur in coding regions. The remaining SNPs are either in non-coding sequence, or on contigs with no significant sequence similarity. For the SNPs found in coding regions, only a subset of the polymorphism, i.e., the non-synonymous substitutions will result in a variation in the amino acid sequence of the encoded protein. SNP studies have reported a higher number of synonymous SNPs (sSNPs) when compared to non-synonymous SNPs (nsSNPs); the variation at non-synonymous sites has the potential to be associated with deleterious mutations. A higher number of sSNPs is usually observed, and this is likely to be the result of evolutionary constraints preferentially eliminating variation at non-synonymous sites. For example, 80% of SNPs identified in coding regions in chicken (Kim et al., 2003) are synonymous compared to 71% for *Schistosoma mansoni* (Simoes et al., 2007), 68% for *Anopheles funestus* (Wondji et al., 2007), 60% for zebrafish (Guryev et al., 2006), and 55% for rat (Guryev et al., 2004). An even higher frequency of sSNPs has been detected in *Salmo salar* (82%). The frequency of sSNP observed in Atlantic cod is intermediate (64%) to that reported for other species.

A preliminary linkage map has been constructed using the SNPs presented herein. This map has been generated using the cross-pollination (CP) parameter set of JoinMap4® (Van Ooijen, 2006), which is applicable to crosses generated from wild individuals taken from an outbred population, and has also been used to generate maps from a small number of crosses in other species (Spigler et al., 2008; Tani et al., 2003). Independent maps were created from the two families B33 and B87, which gave the same number of major linkage groups (23) and a similar overall marker order. Maps generated from these two families were merged to give the consensus map shown in FIG. 5. Preliminary analysis of additional families on a second-generation SNP panel gives additional support to this consensus map. The second generation map shown in Table 10 has been constructed using three families and comprises 23 linkage groups with 1298 mapped markers.

It is possible to generate separate male and female maps for most of the genome of Atlantic cod using the two families genotyped on the two SNP panels described here. The majority of the linkage groups in the consensus map could be identified in sex-specific maps, however these maps are less dense and, due to their bi-allelic nature, only a few informative SNPs are common between maps created with a single individual, making the merging of maps problematic. However, although there appears to be a significant difference in the recombination rates between male and female Atlantic cod (Moen et al., 2009), this has not prevented construction of an integrated map both here and in the previous study (Moen et al., 2009).

The large collection of SNPs described herein for Atlantic cod are of great utility for both the aquaculture industry, and for the management of wild fisheries. As improved automated genotyping systems have been developed, SNPs have become important markers for commercial diagnostics and parental genotyping applications. Due to lower individual information content, a higher number of SNPs is required for parental assignment (Werner et al., 2004) when compared to the microsatellite marker approach that is the current industry standard. In pigs, comparable parental exclusion probabilities have been achieved when using a panel of 60 SNPs or a 10 microsatellite marker panel, but the SNP panel was more sensitive for individual identification (Rohrer et al., 2007). In cattle, panels of 32 and 37 highly informative SNPs were powerful enough to distinguish progeny from multibreed composite populations (Werner et al., 2004; Heaton et al., 2002). In order to develop a powerful SNP panel for cod parental assignment, SNPs must have a high minor allele frequency within the population under study (Werner et al., 2004), and it is also useful if information of linkage between the marker set chosen is available. In total, 332 SNPs markers described herein have a minor allele frequency higher than 0.4 (FIG. 4). This SNP panel may also be used in product traceability applications. It is also possible to apply this large marker set to increase the resolution of population structuring within wild populations of Atlantic cod, and to better monitor the genetic diversity within populations that are being actively fished.

The SNP collection presented here is useful for the genetic analysis of cod fish which may lead to the association of features showing interesting transcriptional responses with QTL intervals, potentially providing useful tools for marker assisted selection. For example, cgpGmo-S1123 is located in the sequence coding for 3-oxo-5-beta-steroid 4-dehydrogenase (AKR1D1). This gene belongs to the Aldo-keto reductase family 1, member D1 and catalyzes the reduction of progesterone, androstenedione, 17-alpha-hydroxyprogesterone and testosterone to 5-beta-reduced metabolites, as well as playing a role in bile acid biosynthesis (Palermo et al., 2008). This gene is of great interest for its role in sexual maturation, and this SNP can be used for marker assisted selection of selected variants.

The SNPs described here have been derived from ESTs, and thus can provide anchor points for more extensive comparative genomic analyses.

The present description provides an extensive resource of SNP markers for Atlantic cod, *Gadus morhua*. The SNPs have been validated across a panel comprising several populations of wild cod, and using two family crosses. This large collection of SNPs is valuable for developing diagnostic assays to distinguish between cod populations, as well as producing tools useful for the aquaculture industry. The genetic linkage map provided is also a valuable resource for QTL discovery and marker assisted selection.

Example 3

Development of a SNP Marker Panel for use in Parentage Analysis of Atlantic Cod (*Gadus morhua*)

Introduction

Single nucleotide polymorphism (SNP) markers have great potential for accelerating studies in the analysis of aquatic species with commercial value. Here, we describe a SNP panel for use in parentage assignment of communally reared Atlantic cod (*Gadus morhua*). SNPs were initially selected from a larger set based on their high minor allele frequency in fish collected from multiple diverse geographic locations throughout the North Atlantic. The 145 SNPs in this initial set were tested to determine their ability to correctly assign parents to progeny from two cod families for which genotyping data was available. SNPs that ranked highly in initial analysis were further tested to determine their performance in assigning parents to a large set of simulated progeny. A medium throughput assay was developed for 48 SNPs, and this SNP panel was analyzed experimentally for its ability to assign parents to a set of communally grown progeny. These progeny had been pre-assigned to parents using a set of six microsatellite markers as part of a more extensive program in selective breeding. The 48 SNP panel performed well on testing, assigning all progeny correctly. However, a panel comprising 30 SNPs, selected from the original 48 on the basis of performance and predicted informativeness, showed the best overall performance, assigning all progeny correctly while allowing for fewer genotyping errors. Panels comprising 24 SNPs or fewer showed deteriorating performance, generating increasing numbers of ambiguous or incorrect assignments. The SNP panel described here is suitable for aquaculture and food traceability applications, and could be improved further with the inclusion of additional SNPs on linkage groups not represented in the current panel.

Molecular traceability tools for economically important aquaculture species, such as Atlantic cod (*Gadus morhua*), can be used both to accelerate the development of elite broodstock suitable for commercial production and to efficiently manage aquaculture stocks. Detection of the parental genetic contribution to successful broodstock can be particularly challenging, since land-based aquaculture production of cod progeny frequently involves mass spawning of numerous parental fish in multiple large breeding tanks (Herlin, et al., 2007), but is essential within a family-based selective breeding program. The alternative to this approach involves growing the progeny of known crosses in individual tanks until they achieve a sufficient size to allow the surgical implantation of a passive integrated transponder tag, before pooling into a large communal tank (Symonds, et al., 2007). The additional infrastructure and fish husbandry costs associated with this alternative approach can be prohibitive.

Although SNP markers have been developed for Atlantic cod (Moen, et al., 2008), a panel of microsatellites (Delghandi, et al., 2003) is still being used for applications such as relatedness testing and parental assignment that are now routinely used in breeding program management. The present Example describes a subset of SNPs from the larger collection of SNPs described in Examples 1 and 2 to develop a marker panel suitable for use in the parental assignment of Atlantic cod.

Materials and Methods

Generation and Maintenance of Atlantic Cod Families

Atlantic cod from the collections used to generate four different year classes from the CGP breeding program (New Brunswick Year Class 1 (NB YC1), New Brunswick Year Class 2 (NB YC2), Newfoundland Year Class 2 (NL YC2) and Newfoundland Year Class 3 (NL YC3) were used in this study, and have been previously described by Bowman et al. (2007). Wild fish to initiate the CGP selective breeding program were collected from Cape Sable, Nova Scotia (NB YC1), Georges Bank and Cape Sable (NB YC2), Bay Bulls, NL (NL YC2) and Smith Sound (NL YC3). Fish were collected in excess of those used as parents in the breeding programs; these are referred to as non-parents, but originate from the same collections as the fish used as parents in those year classes. Fin clips were taken from all wild-caught fish prior to mating. F1 progeny fish for NB YC1 were generated by hand stripping or paired mating of wild-caught adult fish. Progeny fish from NB YC1 were pooled at the larval stage and grown in communal tanks at the St. Andrews Biological Station before transfer to sea cages. A harvest assessment of 2000 progeny from NB YC1 was carried out in fall 2008, at which time fin clip samples were taken for DNA extraction.

DNA Extraction

Briefly, for SNP genotyping (both for Illumina Golden Gate and KBiosciences KASPar assays) fin clip samples were stored in 95% ethanol at room temperature until DNA was extracted using a QIAGEN DNeasy 96 extraction kit (Bowman, et al., 2007) according to the manufacturers instructions. With respect to MS genotyping, fin clip DNA extraction from NB YC1 parents and 2000 NB YC1 progeny was performed by the Research and Productivity Council, Fredericton, New Brunswick, Canada and formed part of a more extensive harvest assessment exercise.

Selection of SNPs for Parental Assignment Testing

Figure 6:
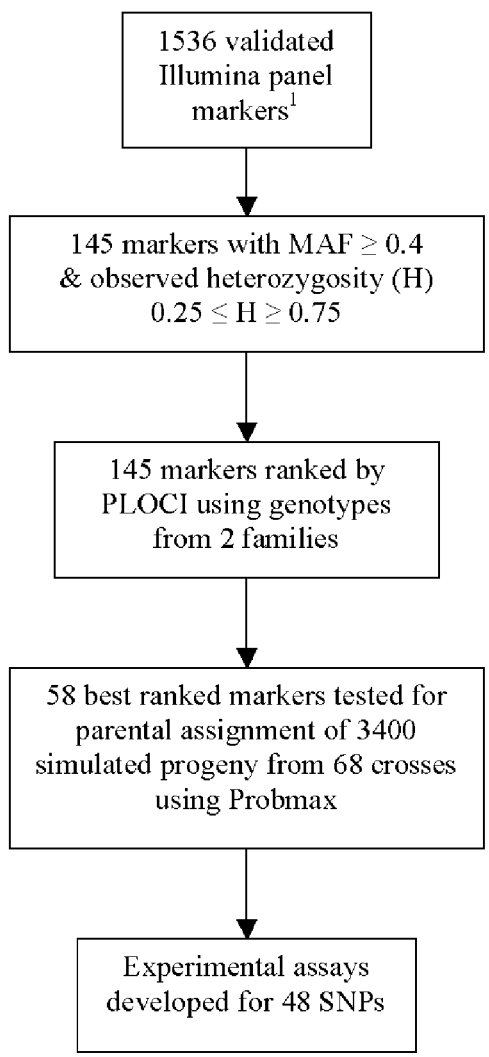
FIG. 6 provides a schematic showing the selection process for SNPs for the parentage panel as described in Example 3.

A set of SNPs suitable for parental assignment was selected from a larger panel of 1536 SNPs were developed and validated using the Illumina GoldenGate Assay as described in Examples 1 and 2. The selection criteria that were used included SNPs having a minor allele frequency (MAF) ≥0.4 (Table 14) and an observed heterozygosity value between 0.25 and 0.75. The initial set of selected SNP markers were ranked using P-LOCI, a parental assignment loci choice software program (Matson, et al., 2008), using genotyping data from the GoldenGate platform for 2 families of NB YC1 (2 parents and 91 progeny), with the genotypes for an additional 64 non-parent fish taken from the four different cod year classes used to populate the cross matrix for assignment. A schematic view of the selection process is shown in FIG. 6. Efforts were made to include SNPs that were located on different linkage groups, or that were not closely linked within groups, although only a preliminary genetic linkage map was available at the time when SNPs were chosen for assay development. Some properties of the 48 SNPs chosen for experimental testing are shown in Table 14.

Generation of Simulated Crosses

Figure 7:
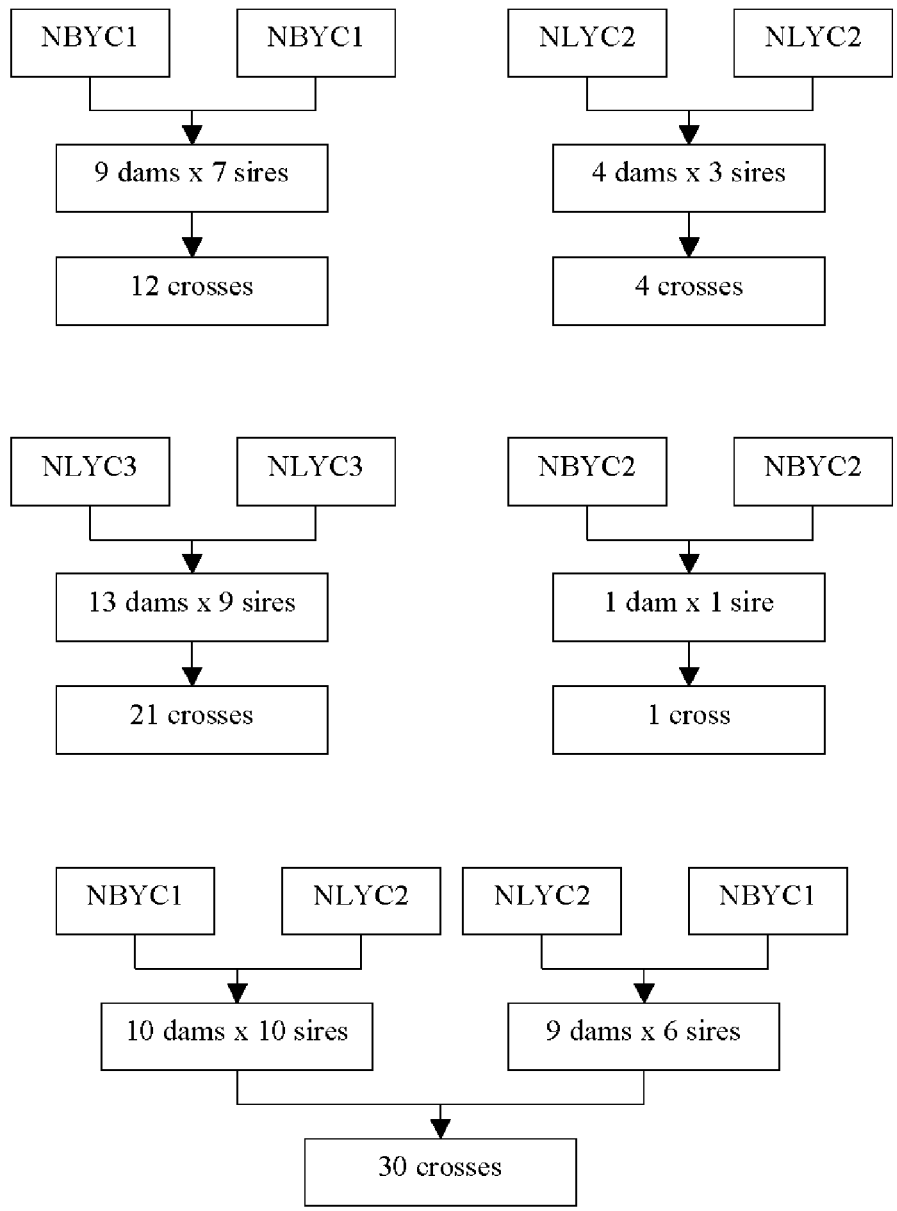
FIG. 7 shows crosses used to generate simulated progeny for in silico parental assignment testing of selected SNPs as described in Example 3. PLOCI was used to randomly generate a set of crosses using genotyping data for 58 SNPs generated from a population study of fish from collections used to generate NB YC1, NB YC2, NL YC2 and NL YC3 families. Fifty simulated progeny were generated per cross.

P-LOCI was used to simulate 3400 progeny genotypes from 4 different year classes (NB YC1, NB YC2, NL YC2 and NL YC3). Genotypes from the same fish used for SNP selection were used to generate simulated crosses. Crosses (68) with 50 progeny per cross were generated (FIG. 7). These crosses were chosen at random for 62 fish for which genotyping data was available from the Illumina GoldenGate platform, with the following two exceptions: a) progeny were generated for two crosses which had been produced experimentally during the course of family generation from NBYC1 (NB2×NB13 and NB291×NB265) and b) one simulated cross was selected to allow testing of parental assignment of a mating between two different regional populations of fish (NBYC2×NLYC2).

Microsatellite Genotyping

A multiplex of six microsatellites was used, which included Gmo8, Gmo19, Gmo37 (Miller, et al., 2000), Tch5, Tch11 (O'Reilly, et al., 2000) and PGmo38 (Jakobsdottir, et al., 2006). Genomic DNA was prepared from finclips using the Wizard SV 96 genomic DNA purification kit (Promega) according to manufacturers instructions. Microsatellite sequences were amplified from individual DNA preps using PCR, with final primer concentrations of 0.05 µM for PGmo38, 0.1 µM for Gmo8, Gmo19 and Tch11, 0.2 µM for Tch5 and 0.4 µM for Gmo37. Cycling conditions were as follows; an initial denaturation step of 95° C. for 15 mins, 35 cycles of 94° C. for 30 s, 55° C. for 90 s and 72° C. for 60 s, with a final elongation step at 60° C. for 30 min. Amplicons were analyzed following electrophoresis using a ABI Prism® 3100 Genetic Analyzer (Applied Biosystems) and alleles were identified after comparison to internal fluorescent size standards (Genescan 500LIZ, Applied Biosystems). Microsatellite genotyping was performed at the Research and Productivity Council, Fredericton, New Brunswick, Canada.

SNP Genotyping of Selected Markers Using KASPar Genotyping Assays

For experimental testing of the parental assignment panel, genomic DNA samples were genotyped using KBiosciences' KASPar homogenous fluorescent endpoint SNP genotyping system. SNP genotyping primers were designed using KBiosciences Primer Picker software. Briefly, DNA (25 ng) was genotyped in the following 8 ml reaction: 0.165 mM allele specific primer 1, 0.165 mM allele specific primer 2, 0.330 mM common reverse primer and 1.5-2.2 mM $MgCl_2$. The samples were thermally cycled on an Applied Biosystems 9600 GeneAmp PCR System in 384 well reaction plates under the following conditions: 94° C. for 15 minutes followed by 20 cycles of 94° C. for 10 seconds, 57-60° C. for 5 seconds, 72° C. for 10 seconds, followed by an additional 18 cycles of 94° C. for 10 seconds, 57° C. for 20 seconds, 72° C. for 40 seconds. The plate was allowed to cool to room temperature before being read using the StepOne System fluorescent plate reader (Applied Biosystems). Genotypes were automatically called and clustered using the StepOne with the Autocaller software provided (Applied Biosystems).

Parental Assignment of Progeny

Parental assignment for both simulated and real progeny was carried out using the exclusion-based parentage assignment program Probmax (Danzmann, 1997). Genotype data from the Illumina GoldenGate Assay for selected SNP markers was used to assign 91 progeny from each of 2 families of NB YC1 cod. Probmax was also used in the assignment of simulated progeny, with tests run allowing 0, 1, 2, 3, 4 and 5 genotyping errors per cross. The maximum number of mismatch alleles was set to 0, 1 or 2 when testing the experimental panel of SNPs. Parentage was determined using ProbMax which calculates the maximum probability of progeny assignments to a mixture of possible contributing parents using genotype data from parents and progeny at several loci (Danzmann 1997). ProbMax can also be used to identify siblings in that sibling fish will have the same parent set identified. Other methods known in the art for determining relatedness or parentage based on genotype data may also be used with the SNPs identified herein.

Results

Selection of SNPs for Parental Assignment

A set of 1536 validated polymorphic SNPs were analyzed to determine their observed heterozygosity values and minor allele frequencies for a set of samples collected from multiple locations across the North Atlantic. These SNPs had originally been selected from a larger set for inclusion on an Illumina GoldenGate panel that was designed for use in QTL analysis as described in Example 2. In total, 145 SNPs had both a MAF of ≥0.4 and an observed heterozygosity falling between 0.25 and 0.75 (FIG. 6). These SNPs were selected for further analysis.

Initially, the genotype data for these 145 SNPs from two families of NB YC1 cod were used to rank the parental assignment value of SNP markers by P-LOCI, with 2 parents and 91 progeny analyzed for each cross. The 58 highest ranked SNPs having parental assignment values of 25% or greater were subjected to additional testing using simulated crosses prior to experimental assay development.

Validation of SNP Panel Using P-LOCI Simulated Progeny and KASPar Genotyping Assays P-LOCI was used to simulate the genotype data for 50 progeny fish generated from each of 68 crosses (FIG. 7). The 62 fish used as virtual parents in the simulated crosses had been genotyped for the 58 selected SNPs using the Illumina GoldenGate assay, and originated from populations that had been used in multiple year classes from each of the two breeding programs, including NB YC1, NB YC2, NL YC2 and NL YC3 and four parent fish from NB YC1 (FIG. 7). Simulated crosses included same year class/same breeding program, same year class/different breeding program, and different year class/different breeding program. These crosses also included many half-sib crosses, where the same dam or sire had been crossed with different individuals, to mimic the cross structure used by the breeding programs.

Progeny simulated for 2 NB YC1 families (13×1002 and 291×1265) are real broodstock crosses used in the CGP breeding programs, but progeny genotype data was simulated in PLOCI for this parental assignment exercise. Probmax was used to assign parentage to 3400 simulated progeny genotypes in several rounds of analysis, allowing 0, 1, 2, 3, 4 or 5 genotyping errors, and tested how many markers were necessary for correct parental assignment. These tests showed that 48 markers correctly assigned 99.99% of simulated progeny after allowing for 1 genotyping error.

Comparison of Selected SNPs with Microsatellite Markers for Parental Assignment

As part of selective breeding programs, a set of progeny fish from different families were mixed prior to tagging, and had been grown to harvest weight in a common environment. These fish were assigned to families using a panel of six microsatellite markers in order to develop an experimental SNP panel using the markers tested in silico and to use this for parental assignment of cod progeny using an experimental design that approximated a commercial breeding setting. Individual SNP assays were developed for 48 of the selected SNPs using the KASPar SNP genotyping chemistry. Using the 48 SNP assays, 42 NB YC1 parental DNA samples, and also 93 NB YC1 cod progeny that had previously been genotyped and assigned to parents using the MS marker set were genotyped. Data from SNP genotyping was used to assess the parental assignment properties of the selected SNP panel.

Progeny were chosen for analysis that assigned to parents with no mismatches using the multiplex of six microsatellite markers. The microsatellite-assigned parents were considered to be the correct parents for the purpose of this study. SNP genotypes were generated for the 93 cod progeny and Probmax was used to assign parents allowing zero, one, two and three genotyping mismatches, at which point all progeny were assigned. In all cases, the parents identified were identical to those identified using the microsatellite study. Fifty progeny (53.8%) assigned with no mismatches, with a further 31 (33.3%), 10 (10.7%) and 2 (2.2%) assigning with one, two and three mismatches respectively. In total, 57 out of 4416 genotypes (1.3%) were considered to be inconsistent between parent and progeny pairs (Table 15).

Of the SNPs generating errors, 23 (40.4%) arise from a single SNP, S1001 (Table 15). When examining the cluster plot from this SNP using the KASPar assay, one allele appears over-represented. After analysis of the data generated by the Illumina GoldenGate platform, this SNP scored as having a high minor allele frequency (0.49). However, primers used for the KASPar assay are not necessarily identical to those used by the GoldenGate assay, i.e. they may be of different length and therefore could have different properties. It is most likely that the KASPar assay failed to amplify one of the two alleles for S1001, resulting in the high incidence of genotyping miscalls seen for this SNP. When examining the incidence of SNP failures with respect to family, three families (B21, B23 and B24) dominate, harboring 10 (17.5%), 9 (15.8%) and 6 (10.5%) of the problem genotypes (Table 16). Two individuals contributing to these families, M1330 (sire for B21 and B24) and F182 (dam for B21 and B24) are associated with 28% and 26.3% of the miscalled SNPs respectively (Table 16).

Linkage Analysis

As set out in Example 2, a genetic linkage map has been generated for Atlantic cod. This map was created using the two NB YC1 families described earlier, and has 23 major linkage groups, with 924 mapped SNPs. The current version of the map contains 1298 SNPs. It was thus possible to locate the majority of the SNPs chosen for inclusion in this analysis, and to identify SNPs that are closely linked (Table 14). In total, SNPs from the final set used for experimental parental assignment were mapped to 18 of the 23 linkage groups. It was not possible to locate six SNPs on the current linkage map; S1168, S1440, S1498, S1593, S1606 and S1631. In addition, five linkage groups, CGP 1, 7, 13, 21 and 23 do not contain a mapped SNP that is part of the current panel. The number of SNPs per linkage group ranges from one (CGP 3, 6, 10, 14, 15, 16, 18, 20 and 22) to six (CGP 19).

Tests Using a Smaller SNP Set for Parental Assignment

The cost-effectiveness of a SNP panel is dependant on the number of SNPs required. To determine the minimum number of SNPs necessary for correct, unambiguous parental assignment we removed SNPs sequentially from the set, and used Probmax to test the smaller SNP panel for its ability to correctly assign progeny. SNPs were removed selectively from the original panel, starting with the SNPs that had generated inconsistent genotyping results, followed by SNPs that were closely linked to other SNPs included in the panel. Due to the removal of SNPs that were responsible for genotyping errors, the stringency of the assignment criteria could be increased, with the number of mismatches necessary to allow assignment of parents to all progeny reduced from three for the 48 SNP panel, to two for a 36 SNP panel and one for 30, 24, 20 and 16 SNP panels. A 30 SNP panel proved to be the best performing SNP set, with all progeny correctly and unambiguously assigned, allowing for one genotyping mismatch (Table 17). However, using SNP panels of 24 SNPs and below resulted in a progressive increase in ambiguous and incorrect assignments. The smallest panel tested comprised 16 SNPs, achieving 79 correct, 12 multiple and two incorrect family assignments (Table 17).

Discussion

The present Example identifies a set of SNPs that are highly polymorphic in the populations of Atlantic cod that had been used to set up breeding programs based in NB and NL. A set of 145 SNPs with high MAF and high (but not extreme) levels of heterozygosity (between 0.4-0.5 and 0.25-0.75 respectively) were selected for further analysis. These SNPs were ranked using two families for which genotyping data was available, and the top 58 SNPs tested using a larger set of families that were simulated using genotyping data (FIG. 6). During this testing, a panel of 48 SNPs was sufficient to correctly assign 100% of the 3400 simulated progeny.

Experimental assays for 48 selected SNPs (Table 14) using KASPar chemistry were developed and used to genotype a set of parents and progeny that had been generated experimentally as part of the NB-based program in selective breeding. KASPar SNP genotyping cannot be highly multiplexed, but is very flexible, relatively inexpensive, and can be used in low, medium and high throughput applications. However, the choice of chemistry means that the multiplexing capabilities of this panel have only been assessed as part of the larger GoldenGate panel.

This 48 SNP panel was successful in unambiguously assigning all progeny to their correct parents. However, a few of the selected SNPs showed a relatively high number of errors, including one problem SNP (S1001) where allele drop out appeared to occur i.e. a single allele was over-represented in the KASPar dataset (Table 15). This SNP originally tested as having a high minor allele frequency using the GoldenGate assay (Table 14), indicating that assay transferability between SNP genotyping platforms is not always successful. Three parents contributing to two families also had a high incidence of SNP miscalling (Table 16). It was necessary to relax the criteria for parental assignment to allow for these sporadic genotyping failures; however all tested progeny assigned unambiguously to their correct parents after allowing for three genotyping failures per assignment (Table 17).

It was possible to position 42 of the SNPs on the genetic linkage map for Atlantic cod. To maximize the informativeness of the SNP panel, it is necessary to select SNPs that are not closely linked. Ideally each SNP would segregate independently, i.e. each SNP would be located on a unique linkage group. However, this would limit the number of useable SNPs to 23 for Atlantic cod, the haploid chromosome number in this species. Therefore, it is necessary to include SNPs that map to the same linkage group, but are not closely linked, as assessed from their location on that group in centimorgans (Cm). Several SNPs in our set of 48 mapped to the same linkage group, with CGP 19 harboring six SNPs (Table 14). Also, five linkage groups were not represented on the current SNP panel (Table 14). Therefore, straightforward measures to improve the current panel include removing SNPs which are closely linked to others, whilst selecting additional SNPs from the original set of 145 highly variable SNPs for inclusion that are located on new linkage groups.

The set of SNPs was tested to determine the minimum number required for parental assignment using data generated experimentally. SNPs were removed sequentially from the set of 48, with the SNPs removed from the set either having a higher incidence of genotyping failure or being located close to others on the same linkage group. A set of 30 SNPs was found to show the best overall performance, assigning all parents correctly and unambiguously (Table 17). It was also possible to use more stringent assignment criteria for this set of SNPs, i.e. allowing for only one genotyping mismatch, as most of the SNPs responsible for genotyping errors had been removed from the set. Panels of 24 SNPs or less were not sufficient to correctly assign all parents (Table 17). The addition of SNPs from linkage groups that were not included in this set may make it possible to further reduce the number of SNPs required for assignment, and thus reduce the cost of the panel.

This first generation SNP panel has identified a set of experimentally robust SNPs, which have been validated in genotyping assays using two chemistries. These SNPs are compatible in a multiplex using GoldenGate technology; KASPar chemistry does not support a high level of multiplexing. This SNP set has the capacity to assign a large number of simulated progeny in an extensive cross structure, and its ability to correctly assign parents to progeny in a smaller number of crosses has been tested experimentally. This panel can discriminate between half-sib crosses, where the same sire has been used with different dams, or vice versa. The present SNP parentage panel can be used in breeding programs for different populations, as many of the SNPs identified as part of the CGP have proved to be highly variable in multiple European populations.

The SNP panel described here is suitable for use in family assignment of communally reared fish, to determine parental contribution n mass spawning, or for genetic analysis as part of a selective breeding program. It would be straightforward to enhance the power of this panel by adding SNPs that are present on the linkage groups not currently represented.

Example 4

SNPs Associated with Resistance to Nodavirus in Atlantic Cod

Introduction

Nodavirus has been identified as a potential disease risk associated with the development of cod aquaculture and one of the greatest threats in this development (Bricknell et al. 2006). Worldwide, this disease has been reported to cause high mortalities in more than 20 marine fish species and with the same viral strains causing disease across species. Nodavirus is referred to as VER (viral encephalopathy and retinopathy) or VNN (viral nervous necrosis as the disease targets the neural tissues and retina. This importance has led Norwegian researchers to identify this disease as one of interest for further research in their cod breeding program (Odegard et al. 2010). Nodavirus can result in high mortalities in juvenile fish and to a lesser extent in adult fish.

Material and Methods

Broodstock

Wild Atlantic cod were obtained from three sites off North America in late 2006 for ambient spawning in 2007. Broodstock were caught off Georges Bank (Northwest Atlantic Fisheries Organization division 5Z) and Cape Sable, Nova Scotia (NAFO Division 4x). Cod broodstock were transported to the Department of Fisheries and Oceans, St. Andrews Biological Station, Canada (SABS). A third site was located off New Hampshire (NAFO division 5Y) and cod broodstock were transported to Great Bay Aquaculture (GBA), New Hampshire, United States. All broodstock were maintained in tanks on a mixed ration of Atlantic mackerel (*Scomber scombrus*) and northern shortfin squid (*Illex illecebrosus*) with vitamin and mineral supplement twice weekly. Prior to spawning, broodstock were tagged with Passive Integrated Transponders (PIT, Sokymat, Switzerland) and fin clip tissue was collected.

Progeny Production and Sampling

Broodstock handling and fertilization of eggs followed that described in Garber et al. (2009). From 12 Jan. 2007 to 15 Feb. 2007, 40 crosses were generated from 27 female and 24 male broodstock (full and half sibling families, 33 at SABS and 7 at GBA). Thirty-three of the 40 crosses were produced and maintained at SABS. Seven of the 40 crosses were produced at GBA and shipped to SABS 6-10 days post fertilization at which time eggs were stocked in incubators at SABS. Progeny from each cross were stocked into individual 80 l incubators followed by stocking into individual 500 l larval tanks—one family per rearing unit.

The number of fish in each tank was standardized to a constant quantity twice to reduce tank 'density' effects caused by variable numbers of progeny per family tank. The initial standardization occurred at ~123 days post fertilization and all family numbers were decreased to 1500 fish per tank. During the second standardization from 1500 to 450 fish per tank at ~176 days post fertilization, 50 fish from each of 40 families were PIT tagged and stocked into two tanks. On 25 Oct. 2007 (~267 days post fertilization), fish were anaesthetized with 20 mg/l tricaine methane sulphonate (MS-222; Finquel®; Argent Laboratories, Redmond, Wash., USA), PIT tags were scanned, weights were recorded on each fish, fish were injected with 0.1 ml of nodavirus (titer $1\times10^{9.25} TCID_{50}$/ml) for a total challenge dose of $1\times10^{8.25} TCID_{50}$, and each fish was fin clipped prior to stocking into one of two tanks.

Tanks were checked twice daily for dead or moribund fish. Dead fish were removed from the tank, PIT tags were scanned, date recorded and weights or genders were recorded if fish were completely intact. Fish were considered moribund if they were floating toward the surface, flashing, spinning in circles and having an overall pink hue and/or with hemorrhaging in the tail, eye or brain areas and sometimes with exopthalmus of the eye. Moribund fish were removed, placed into a holding container, anaesthetized with MS-222, PIT tags were scanned, weight was recorded and blood was collected. Fish were then killed by pithing and tissue from brain, spleen and head kidney was collected for microarray analysis. Gender of each fish was also recorded at time of sampling.

Data was recorded on 1626 fish from 40 families as they became moribund or 70 days after the study was initiated when all remaining fish were terminated. Of the 1626 fish, 232 fish from 30 families were included in the QTL analysis. Families were selected for the QTL analysis based on their relatedness (half siblings) and susceptibility to nodavirus. Approximately 10 fish per family were selected (five of the most susceptible and five of the least susceptible individuals in each family).

DNA was isolated from fin clip tissue. A selective genotyping approach was used to maximize the probability of detecting QTL segregating in the population. The DNA isolation and genotyping process to identify SNPs were as described in Examples 1 and 2.

Quantitative Trait Loci Analysis

Of the 332 Noda challenged fish 185 died at a mean weight of 29.2 gm (9.7-71.3) were given a death status of 1. The balance of the fish alive at the end of the test period with a mean weight of 50.85(16-102.6) were given a death status of 0.

A generalized linear mixed model was fitted to test the association between death status and each individual SNP assuming a binomial distribution of errors (SAS 9.1, GLIMMIX macro). A covariate of death weight along with classification effects including family and gender with family fitted as random death status were also fitted. A linkage group-wise multiple test adjustment for Type I error rate (Benjamini and Hochberg, 1995) was used assuming each linkage group segregating independently and is therefore a unique experimental unit.

Results

As shown in Table 18, on linkage group 8 and 19 two SNPs were significantly associated with nodavirus and remaining significant with a false discovery rate<0.1. In addition, on linkage group 23 there were two SNPs significantly associated with nodavirus and remaining significant with a false discovery rate<0.1.

Example 5

Genetic Markers Associated With Growth in Atlantic Cod

Introduction

Many practical breeding situations exist in which trait-based selection index is inefficient or impractical, such as traits that cannot be scored on all individuals (carcass composition) or with low heritability (fertility traits and disease resistance). In these instances marker-based selection can create a significant gain (Weller, 2001). This Example provides SNP markers suitable for use in trait-based selection for growth in cod.

Materials and Methods

Fish

Progeny for this study were obtained from wild-caught founders from three eastern North American regions caught in 2005 for ambient spawning in 2006. All broodstock were maintained in tanks on a mixed ration of Atlantic mackerel (*Scomber scombrus*) and northern shortfin squid (*Illex illecebrosus*) with vitamin and mineral supplement twice weekly. Broodstock handling and fertilization of eggs followed that described in Garber et al. (2009). This study includes progeny from 19 families that were reared at the New Brunswick and New Hampshire facilities from 2006 to 2009.

Full-sib families were reared separately until the family reached an average weight of 15 grams, which occurred at an average of 220 days post fertilization (DPF). Families were then implanted with Passive Integrated Transponder (PIT) tags, used to mark and identify individual fish, and then moved to a single 1008 m³ sea cage in New Brunswick. Family performance related to growth, survival and overall health was recorded. Fish were harvested from the sea cages at an average of 990 DPF (s.d. 10.6) and 968 (s.d. 11.1) days post hatch (DPH).

Post-Mortem Measurements and Genotyping

Standard length (SL) was defined as the length from the tip of the upper jaw to the posterior end of the hypural plate. Weight (Wt) was taken on unconscious individuals. For bled weight (BledWt) the gills were slit and the fish were allowed to bleed out for approximately 4 hours before the carcass was weighed. Gutted weight (HOGWt) is the weight of an eviscerated carcass with the head attached. Gonad weight (GonadWt) and liver weight (LiverWt) are the weights of the respective organs. Skin on fillet (SOnWt) and skin off fillet (SOffWt) weights are the weight of a standard commercial fillet with the skin intact or removed, respectively, left and right fillets weighed together for a total weight of marker product per fish.

Atlantic Cod are a diploid species with 46 chromosomes (Johansen et al, 2009). A total of 1,298 single nucleotide polymorphisms (SNPs) were tested for association with a number of growth and carcass composition traits.

Fin clip tissue was taken at harvest in the processing facility. A selective genotyping approach was used to maximize the probability of detecting QTL segregating in the population. Individuals for genotyping for this study were selected based on Wt; the 10 heaviest and 10 lightest progeny for each family were chosen, regardless of fish gender.

Statistical Analyses

Growth traits were analysed using the Mixed procedure in SAS (SAS 9.1) fitted using linear model assuming a normal distribution of errors (SAS 9.1, mixed macro). Classification effects included sire, dam and gender with sire and dam effects fitted as random. A linkage group-wise adjustment for error rate was used assuming each linkage group (chromosome) was independent and that loci on different linkage groups segregated independently.

The model for Wt and BledWt is as follows:

$$Y_i = \mu + Sire + Dam + Gender + Gender \times GonadWt + GonadWt + e \quad [1]$$

Where Y is the Wt or BledWt phenotype of the animal i, sire, dam and gender are as described above, and e is the residual error. The model for HOGWt was [1] with the inclusion of SL as a covariate to account for the size of the fish. The model for SL was the same as [1] but included BledWt as a covariate to account for the weight of the fish. The possibility that maturity might have an impact was accounted for through the inclusion of the Gender by GonadWt interaction and GonadWt alone as a covariate.

The model for SOnFWt, SOffFWt and GonadWt was as follows:

$$Y_i = \mu + sire + dam + gender + BledWt + SL + DPH + e \quad [2]$$

Where Y is the phenotype of the animal i, sire, dam and gender are as described above, DPH is described above and e is the residual error. The model for LiverWt was the same as [2] but did not include DPH because it was not found to significantly affect LiverWt. Variables were identified as significant factors to include in the various models through backwards elimination at p<0.05.

Results

The eight growth and carcass composition traits were recorded for 351 fish, of which 159 were male and 192 were female.

On linkage group 7, there were 15 SNPs associated with Wt, 14 associated with BledWt, and 17 associated with HOGWt (Table 20). Seventeen of the 19 SNPs that were significantly associated with growth and carcass composition traits were found within a very tight region around 19.147cM into the linkage group. The Pearson product-moments correlations between Wt, BledWt and HOGWt were above 98% indicating that these traits were essentially equivalent. When the weight of the fish was accounted for, no SNPs were found to be associated with SL.

In addition to the large cluster of SNPs associated with the weight traits on Linkage Group 7, some associations were found in other linkage groups as shown in Table 21. Two SNPs were found to be significantly associated with each of SOnFWt, SOffFWt, GonadWt and LiverWt. Linkage group 23 had two SNPs with significant associations, one with LiverWt and one shared by SOnWt and SOffWt. Four other linkage groups (1, 18, 22 and 23) had significant SNP associations, two SNPs associated with GonadWt on linkage groups 18 and 22, one shared association with HOGwt and two SNPs associated with LiverWt on linkage groups 1 and 23. Table 21 identifies the preferred alleles associated with increased weight (SOnFWt, SOffFWt) as well as the preferred alleles associated with a reduction in weight (GonadWt and LiverWt).

The fillet traits had a Pearson product-moment correlation of 0.996 indicating that phenotypically they are the same trait. SOffWt and SOnWt respectively had a correlation of 0.284 and 0.300 with GonadWt and 0.875 and 0.882 for LiverWt. The fillet traits had correlations with BledWt, Wt, and HOGWt increasing from 0.943 to 0.974 respectively. LiverWt had a correlation of 0.425 with GonadWt, and ranged from 0.894 to 0.928 with GuttedWt, Wt and BledWt respectively. GonadWt had a correlation that ranged from 0.352 to 0.493 for GuttedWt, Wt and BledWt.

Discussion

Twelve out of 20 SNPs associated with the QTL on linkage group 7 were associated with all three measures of weight of the fish as they showed associations with Wt, BledWt and HOGWt. This is consistent with a QTL or region influencing overall growth as each measure of weight has a component of the overall weight of the fish. All of these SNPs with significant associations are located in a very tightly spaced region of linkage group 7 and therefore one would suspect that a single QTL with a large effect on growth is segregating in this region. In this circumstance, the single SNP that is most significantly associated with all three growth traits is probably sufficient to use for marker assisted selection for increased growth.

These associations will enable marker-assisted selection within Atlantic cod breeding programs, leading to rapid enhancement of cod broodstock.

Example 6

A Sex Determining Region in Atlantic Cod

Introduction

Vertebrates employ diverse mechanisms to produce progeny of different sex, including systems that can be environmental, genetic or both (Peichel et al 2004). Even when genetic gender determination is established, the precise mechanism by which this occurs can vary, since the genes or chromosomal systems involved can differ depending on the species. The XY system of sex determination, employed by humans and other mammals, involves cytogenetically distinct chromosomes that are so divergent in sequence that no genetic recombination occurs between the Y and X chromosomes. Other systems of sex determination include the WZ system common in avian species whereby females are the heterogametic sex, morphologically similar sex chromosomes, or the use of several genes on multiple autosomes. Atlantic cod are a diploid species with 46 chromosomes (Johansen et al, 2009). As with many fish species, there are no cytogenetically obvious sex chromosomes with Atlantic cod but beyond that, the mechanism of sex determination in cod is unknown.

Atlantic cod (*Gadus morhua*) inhabit benthopelagic environments in the North Atlantic Ocean where they contribute to the economy and cultural identity of people living in the coastal areas (Johansen et al, 2009). A high consumer demand coupled with a general decline in cod stocks has stimulated the development of cod aquaculture in several countries including Norway, the United States and Canada (Garber et al., 2009).

Materials and Methods

Fish

Broodstock for this experiment were wild-caught founder stock from three eastern North American regions. This study includes the progeny of 19 families that were part of the New Brunswick and New Hampshire stock reared at St. Andrews Biological Station, St. Andrews, New Brunswick, Canada in 2005/2006. All broodstock were maintained in tanks with ambient water temperature and photoperiod and fed a mixed ration of Atlantic mackerel (*Scomber scombrus*) and northern shortfin squid (*Illex illecebrosus*) with vitamin and mineral supplement twice weekly.

Full-sib families were reared separately until the family reached an average weight of 15 grams, which occurred at an average of 220 days post fertilization (DPF). Fish were then fitted with Passive Integrated Transponder (PIT) tags to identify individual fish, and moved to a single 1008 $m^3$ sea cage in New Brunswick coastal waters. Family performance related to growth, survival and overall health was recorded. Individuals for this study on gender determination were the same subset of the fish harvested for growth and carcass characteristic studies, as gender was being determined during carcass composition dissection. These fish were primarily selected based on the 10 largest and 10 smallest progeny for each family, regardless of fish gender at time of harvest which occurred an average of 990 DPF (std 10.6) and 968 (std 11.1) days post hatch (DPH). Gender balance in the subset was determined before further analysis to avoid a gender bias due to the primary interest in growth rate.

Gender Determination and Genotyping

Gender was confirmed at harvest by direct observation of the gonads during carcass dissection. Finclips were taken at harvest for genotyping. DNA extracted from these finclips was genotyped using an Illumina Golden Gate panel consisting of 1532 single nucleotide polymorphisms as described in Example 2. Groups of SNPs from individual linkage group were used for analysis, with each linkage group representing a separate experiment; these were extracted from a linkage map comprising 1298 mapped SNPs.

The generalized linear mixed model was fitted using straight association analysis assuming a binomial distribution of errors (SAS 9.1, GLIMMIX macro). Classification effects included sire, dam and gender with sire and dam fitted as random and gender fitted as the dependent variable. A chromosome-wise adjustment for error rate was used assuming each chromosome is segregating independently and is therefore a unique experimental unit.

Results

A total of 159 males and 192 females were genotyped. Twenty SNPs were found to be significant on linkage group 11 and one on linkage group 15 (Table 22). The SNPs with significant associations with gender on linkage group 11 were spread over a distance of 23.744 cM with 14 of those SNPs having a false discovery rate (FDR) adjusted p-value of less than 1%, indicating that linkage group 11 is a putative sex chromosome in Atlantic cod.

Some interesting patterns emerge when considering a few families and looking at one SNP at a time. In these cases, when the female is heterozygous and the male is homozygous at specific SNPs, the alleles from the female are relatively evenly distributed to both males and females. However, in the cases where the male is a heterozygote and the female is a homozygote, male alleles tend to be distributed with one going to the male progeny and the other going to the female progeny. These two cases were consistent with an XY system and the male being the heterogametic sex. There are a few SNPs that do not fit this overall pattern. With these SNPs, the patterns are mostly consistent with a dropout of one allele in particular lineages, which might again be consistent with cod Y chromosome losing genetic information on the way to becoming similar to the Y chromosome found in humans.

Example 7

SNPs Associated With Cortisol Responsiveness in Stressed Atlantic Cod

Introduction

The present Example identifies SNPs associated with a reduced a cortisol response in fish exposed to handling stress. Fish that exhibit reduced level of cortisol in response to stress are better suited to acquaculture.

Materials and Methods

Fish

All broodstock were maintained in tanks with ambient water temperature and photoperiod and fed on a mixed ration of Atlantic mackerel (*Scomber scombrus*) and northern shortfin squid (*Illex illecebrosus*) with vitamin and mineral supplement twice weekly.

Full-sib families were reared separately until the families reached an average mass of 15 grams, which occurred at an average of 220 days post-fertilization (DPF). Families were then implanted with Passive Integrated Transponder (PIT) tags to mark and identify individual fish.

Thirty fish from each of nine full-sib families were transported to the National Research Council of Canada—Marine Research Station in Ketch Harbor, NS. Fish were first acclimated for a month in 2 500-L flow-through sea-water tanks (at 10° C. with DO above 90%). After the initial acclimation period, the fish were sorted according to family ID into 9 different tanks (150-L flow-through sea-water tanks with the same conditions as the holding tanks. Briefly, after one month of acclimation to the family tanks, fish were lightly anesthetized in TMS (tricaine methanesulfonate; 100 mg/L) and had blood immediately sampled (~100 µl) from the caudal vein. Plasma was separated by centrifugation and stored at −80° C. until cortisol analysis of resting cortisol levels (RCortisol). Thereafter, fish were submitted to 5 stress events, these events separated by ~one month. For each event, fish were submitted to a 30 seconds net-stress (i.e. being exposed to air in a net for 30 seconds) and were allowed one hour to elicit the cortisol response under holding conditions. After this one-hour period had elapsed, blood was sampled and processed as before. Resulting plasma was used to assess post-stress plasma cortisol levels (MCortisol).

Plasma cortisol levels were quantified using an Enzyme-Linked Immunosorbent Assay (ELISA) (Neogen Corp., Lexington, Ky.) previously validated for cod. For this analysis, thirty µl of plasma were diluted in 270 µl of the provided EIA buffer, and quantification was performed in duplicate following the manufacturer's instructions.

Z-scores were calculated for the fish involved in the experiment using all 5 stress sampling points as $Z=(cortisol_{ind}-avg\_cortisol_{allind})/SD_{allind}$, where $cortisol_{ind}$ is the value for a given individual, $avg\_cortisol_{allind}$ is the average cortisol of all individual at a given sampling point and $SD_{allind}$ is the standard deviation of all individuals at a given sampling point. A given individual had 5 Z-scores, each representing its cortisol responsiveness at one sampling point. Total Z-score (Zt) was calculated as the sum of all Z-scores for a given individual. For genotyping fish with the 5 highest (i.e. consistent high cortisol response) and lowest (i.e. consistent low cortisol response) Zt within each family were selected.

Post-Mortem Measurements and Genotyping

A total of 1298 single nucleotide polymorphisms (SNPs) were tested for association with cortisol levels.

The difference (DCortisol) between the resting cortisol level (RCortisol) and the average of the 5 post-stress cortisol levels (MCortisol) was fitted using straight association analysis assuming a normal distribution of errors (SAS 9.1, mixed macro). Classification effects were Sire and Dam fitted as random. A chromosome wise adjustment for error rate was used assuming each chromosome is independent and a unique experiment unto itself.

The model for DCortisol=(MCortisol−Rcortisol) was:

$$Y_i = \mu + Sire + Dam + Zt + Weight + e$$

Where Y was the phenotype of animal i, Zt was the average Z score over 5 months (March-July), Weight was the average live weight over 5 months and e was the residual error.

Results

Cortisol levels and live weight were recorded for 90 fish as set out in Table 23. The SNPs identified in Table 24 are associated with fish with reduced cortisol levels in response to stress. High cortisol levels are associated with stress conditions in fish. Fish that are highly stressed that exhibit high levels or cortisol in response to stress exhibit reduced growth and reduced immune robustness.

Accordingly, marker-assisted selection of Atlantic cod with the preferred alleles listed in Table 24 allows for the selection of fish resistant to stress and enhancement of broodstock.

While the present disclosure has been described with reference to what are presently considered to be the preferred examples, it is to be understood that the application is not limited to the disclosed examples. To the contrary, the disclosure is intended to cover various modifications and equivalent arrangements included within the spirit and scope of the appended claims.

All publications, patents and patent applications are herein incorporated by reference in their entirety to the same extent as if each individual publication, patent or patent application was specifically and individually indicated to be incorporated by reference in its entirety.

TABLE 1

SNP detection in manual (PTA) and automated (PolyPhred) pipelines [1]

| Contig name | NCBI_SS | Clustering software | Length | nbre seq | location | substitution | n 1st | n 2nd |
|---|---|---|---|---|---|---|---|---|
| PTA_1803.c1 | #N/A | PTA | 819 | 8 | 322 | T/C | 2 | 6 |
| PTA_1473.c1 | 105434840 | PTA | 713 | 6 | 429 | G/A | 4 | 2 |
| PTA_1153.c1 | 105434836 | PTA | 898 | 9 | 541 | G/A | 6 | 3 |
| PTA_233.C1 | #N/A | PTA | 862 | 12 | 485 | C/T | 5 | 7 |
| PTA_703.C2 | 105434856 | PTA | 784 | 6 | 462 | C/T | 4 | 2 |
| PTA_624.C1 | 105434854 | PTA | 687 | 11 | 184 | C/G | 8 | 3 |
| PTA_1764.c1 | 105434844 | PTA | 881 | 10 | 528 | G/A | 7 | 3 |
| PTA_1641.c1 | 105434841 | PTA | 958 | 10 | 397 | A/T | 6 | 4 |
| PTA_1090.c1 | 105434839 | PTA | 775 | 8 | 204 | G/A | 2 | 6 |
| PTA_179.c1 | 105434845 | PTA | 758 | 9 | 546 | C/T | 7 | 2 |
| PTA_912.c1 | 105434858 | PTA | 1110 | 5 | 273 | G/A | 3 | 2 |
| PTA_423.c1 | 105434851 | PTA | 1136 | 7 | 728 | C/T | 4 | 3 |
| PTA_056.c1 | #N/A | PTA | 789 | 10 | 594 | C/A | 5 | 5 |
| PTA_685.c1 | #N/A | PTA | 844 | 9 | 549 | C/A | 5 | 4 |
| PTA_657.c2 | 105434855 | PTA | 780 | 5 | 461 | C/G | 2 | 3 |
| PTA_463.c2 | 105434853 | PTA | 975 | 5 | 458 | A/G | 3 | 2 |
| PTA_854.c1 | 105434857 | PTA | 1016 | 9 | 700 | G/T | 4 | 5 |
| PTA_028.c1 | #N/A | PTA | 692 | 6 | 178 | G/C | 3 | 3 |
| PTA_449.c1 | 105434852 | PTA | 1001 | 8 | 685 | T/A | 3 | 5 |
| PTA_2675.c1 | 105434847 | PTA | 816 | 8 | 458 | A/G | 6 | 2 |
| PTA_153.c1 | 105434843 | PTA | 789 | 6 | 255 | A/G | 2 | 4 |
| PTA_1435.C1 | 105434837 | PTA | 1057 | 10 | 697 | G/A | 5 | 5 |
| PTA_263.C1 | #N/A | PTA | 1324 | 11 | 666 | T/G | 9 | 2 |
| PTA_1522.c1 | 105434838 | PTA | 783 | 8 | 561 | C/T | 4 | 4 |
| PTA_286.c1 | 105434850 | PTA | 997 | 8 | 317 | T/G | 6 | 2 |
| PTA_276.c1 | 105434849 | PTA | 740 | 6 | 193 | C/A | 4 | 2 |
| PTA_2083.c2 | 105434846 | PTA | 1144 | 6 | 328 | G/A | 3 | 3 |
| PTA_018.C2 | #N/A | PTA | 1143 | 11 | 803 | A/G | 8 | 3 |
| PTA_275.c2 | 105434848 | PTA | 814 | 7 | 421 | C/G | 4 | 3 |
| PTA_079.C1 | 105434835 | PTA | 884 | 12 | 370 | A/G | 1 | 11 |
| PP_1060.c1 | 105434834 | Polyphred | 1077 | 9 | 274 | A/T | 4 | 5 |
| PP_1062.c1 | #N/A | Polyphred | 1189 | 16 | 338 | A/C | 10 | 6 |
| PP_1063.c1 | #N/A | Polyphred | 859 | 10 | 345 | C/T | 6 | 4 |
| PP_1072.C1 | 105434859 | Polyphred | 846 | 11 | 296 | A/C | 6 | 5 |
| PP_1092.C1 | 105434860 | Polyphred | 868 | 14 | 200 | A/G | 7 | 7 |
| PP_1108.C1 | 105434861 | Polyphred | 806 | 6 | 649 | A/T | 2 | 4 |
| PP_1120.C1 | 105434862 | Polyphred | 1062 | 8 | 514 | C/T | 5 | 3 |
| PP_1159.C1 | #N/A | Polyphred | 453 | 6 | 310 | A/G | 3 | 3 |
| PP_1164.C1 | #N/A | Polyphred | 822 | 6 | 158 | A/C | 2 | 4 |
| PP_1206.C1 | 105434863 | Polyphred | 845 | 10 | 528 | A/G | 6 | 4 |
| PP_1657.C1 | 105434866 | Polyphred | 859 | 7 | 247 | C/T | 5 | 2 |
| PP_161.C1 | 105434865 | Polyphred | 1291 | 4 | 296 | C/G | 1 | 3 |
| PP_147.C1 | #N/A | Polyphred | 764 | 10 | 333 | G/T | 3 | 7 |
| PP_1301.C1 | #N/A | Polyphred | 859 | 7 | 112 | A/G | 2 | 5 |
| PP_127.C1 | #N/A | Polyphred | 848 | 8 | 440 | A/G | 5 | 3 |
| PP_134.C1 | 105434864 | Polyphred | 1248 | 4 | 709 | C/T | 1 | 3 |
| PP_1480.C3 | #N/A | Polyphred | 885 | 6 | 502 | A/G | 4 | 2 |

[1] For each SNP, the accession number in SNPdb, the origin of the consensus sequence used to design the primer (PTA or polyphred software), the length of the contig (Length), the number of reads in that contig (nbre), the coordinates of the SNP within the consensus sequences (location), the allele substitution (substitution), the number of reads with the first allele (n 1$^{st}$) and the number of read with the second allele (n 2$^{nd}$) is indicated.

TABLE 2

Low throughput SNP genotyping in Atlantic cod for two Canadian populations [2]

| SNP ID | Base | N | % b1 | | % b2 | | hetero. | | N | % b1 | | % b2 |
|---|---|---|---|---|---|---|---|---|---|---|---|---|
| | | | | | | NL | | | | | NB | |
| PTA_079.C1 | A/G | 8 | 0 | (0) | 1 | (16) | 0.00 | (0) | 10 | 0 | (0) | 1 |
| PTA_1090.c1 | G/A | 8 | 0.81 | (13) | 0.19 | (3) | 0.38 | (3) | 10 | 0.93 | (26) | 0.07 |
| PTA_1153.c1 | G/A | 8 | 0.44 | (7) | 0.56 | (9) | 0.38 | (3) | 14 | 0.21 | (6) | 0.79 |
| PTA_1435.C1 | A/G | 8 | 0.19 | (3) | 0.81 | (13) | 0.38 | (3) | 14 | 0.39 | (11) | 0.61 |
| PTA_1473.c1 | G/A | 8 | 0.25 | (4) | 0.75 | (12) | 0.50 | (4) | 14 | 0.46 | (13) | 0.54 |
| PTA_1522.c1 | C/T | 8 | 0.81 | (13) | 0.19 | (3) | 0.13 | (1) | 14 | 0.79 | (22) | 0.21 |
| PTA_153.c1 | A/G | 8 | 0.5 | (8) | 0.5 | (8) | 0.25 | (2) | 14 | 0.36 | (10) | 0.64 |
| PTA_1641.c1 | A/T | 8 | 0.75 | (12) | 0.25 | (4) | 0.50 | (4) | 14 | 0.71 | (20) | 0.29 |
| PTA_1764.c1 | A/G | 8 | 0.63 | (10) | 0.38 | (6) | 0.25 | (2) | 14 | 0.75 | (21) | 0.25 |
| PTA_179.c1 | C/T | 8 | 0.69 | (11) | 0.31 | (5) | 0.63 | (5) | 14 | 0.86 | (24) | 0.14 |
| PTA_18.C2 | A/G | 8 | 0.88 | (14) | 0.13 | (2) | 0.25 | (2) | 13 | 0.88 | (23) | 0.12 |
| PTA_2083.c2 | A/G | 8 | 0.69 | (11) | 0.31 | (5) | 0.63 | (5) | 14 | 0.71 | (20) | 0.29 |
| PTA_2675.c1 | A/G | 8 | 0.56 | (9) | 0.44 | (7) | 0.63 | (5) | 13 | 0.42 | (11) | 0.58 |

TABLE 2-continued

Low throughput SNP genotyping in Atlantic cod for two Canadian populations [2]

| | | | | | | | | | | | |
|---|---|---|---|---|---|---|---|---|---|---|---|
| PTA_275.c2 | G/C | 8 | 0.69 | (11) | 0.31 | (5) | 0.50 | (4) | 9 | 0.86 | (24) | 0.14 |
| PTA_276.c1 | C/A | 8 | 0.56 | (9) | 0.44 | (7) | 0.38 | (3) | 14 | 0.61 | (17) | 0.39 |
| PTA_286.c1 | G/T | 8 | 0.25 | (4) | 0.75 | (12) | 0.25 | (2) | 14 | 0.21 | (6) | 0.79 |
| PTA_423.c1 | C/T | 8 | 0.06 | (1) | 0.94 | (15) | 0.13 | (1) | 14 | 0.18 | (5) | 0.82 |
| PTA_449.c1 | T/A | 8 | 0.63 | (10) | 0.38 | (6) | 0.25 | (2) | 14 | 0.61 | (17) | 0.39 |
| PTA_463.c2 | A/G | 8 | 1 | (16) | 0 | (0) | 0.00 | (0) | 10 | 1 | (20) | 0 |
| PTA_624.C1 | G/C | 8 | 0.44 | (7) | 0.56 | (9) | 0.38 | (3) | 12 | 0.25 | (6) | 0.75 |
| PTA_657.c2 | C/G | 8 | 0.19 | (3) | 0.81 | (13) | 0.38 | (3) | 10 | 0.07 | (2) | 0.93 |
| PTA_703.C2 | C/T | 6 | 0 | (0) | 1 | (12) | 0.00 | (0) | 8 | 0 | (0) | 1 |
| PTA_854.c1 | G/T | 8 | 0.63 | (10) | 0.38 | (6) | 0.75 | (6) | 14 | 0.86 | (24) | 0.14 |
| PTA_912.c1 | G/A | 7 | 0.29 | (4) | 0.71 | (10) | 0.29 | (2) | 14 | 0.36 | (10) | 0.64 |
| PP_1060.c1 | A/T | 8 | 0.5 | (8) | 0.5 | (8) | 0.25 | (2) | 12 | 0.38 | (9) | 0.63 |
| PP_1072.C1 | A/C | 8 | 0.25 | (4) | 0.75 | (12) | 0.00 | (0) | 14 | 0.43 | (12) | 0.57 |
| PP_1092.C1 | A/G | 7 | 0.07 | (1) | 0.93 | (13) | 0.14 | (1) | 14 | 0.29 | (8) | 0.71 |
| PP_1108.C1 | A/T | 7 | 0.57 | (8) | 0.43 | (6) | 0.86 | (6) | 11 | 0.54 | (13) | 0.46 |
| PP_1120.C1 | T/C | 8 | 0 | (0) | 1 | (16) | 0.00 | (0) | 13 | 0.88 | (3) | 0.12 |
| PP_1206.C1 | A/G | 8 | 0.5 | (8) | 0.5 | (8) | 1.00 | (8) | 14 | 0.46 | (13) | 0.54 |
| PP_134.C1 | C/T | 7 | 0.5 | (7) | 0.5 | (7) | 1.00 | (7) | 10 | 0.5 | (10) | 0.5 |
| PP_161.C1 | C/G | 3 | 0.17 | (1) | 0.83 | (5) | 0.33 | (1) | 8 | 0.38 | (6) | 0.63 |
| PP_1657.C1 | C/T | 8 | 0.25 | (4) | 0.75 | (12) | 0.50 | (4) | 10 | 0.35 | (7) | 0.65 |

| | NB | Total | | | | | |
|---|---|---|---|---|---|---|---|
| SNP ID | hetero. | N | % b1 | | % b2 | | hetero. |
| PTA_079.C1 | (20) 0.00 (0) | 18 | 0 | (0) | 1 | (36) | 0.00 (0) |
| PTA_1090.c1 | (2) 0.20 (2) | 22 | 0.89 | (39) | 0.11 | (5) | 0.23 (5) |
| PTA_1153.c1 | (22) 0.43 (6) | 22 | 0.3 | (13) | 0.7 | (31) | 0.41 (9) |
| PTA_1435.C1 | (17) 0.64 (9) | 22 | 0.32 | (14) | 0.68 | (30) | 0.55 (12) |
| PTA_1473.c1 | (15) 0.64 (9) | 18 | 0.39 | (17) | 0.61 | (27) | 0.72 (13) |
| PTA_1522.c1 | (6) 0.14 (2) | 22 | 0.8 | (35) | 0.2 | (9) | 0.14 (3) |
| PTA_153.c1 | (18) 0.71 (10) | 22 | 0.41 | (18) | 0.59 | (26) | 0.55 (12) |
| PTA_1641.c1 | (8) 0.43 (6) | 22 | 0.73 | (32) | 0.27 | (12) | 0.45 (10) |
| PTA_1764.c1 | (7) 0.21 (3) | 22 | 0.7 | (31) | 0.3 | (13) | 0.23 (5) |
| PTA_179.c1 | (4) 0.29 (4) | 22 | 0.8 | (35) | 0.2 | (9) | 0.41 (9) |
| PTA_18.C2 | (3) 0.23 (3) | 21 | 0.88 | (37) | 0.12 | (5) | 0.24 (5) |
| PTA_2083.c2 | (8) 0.43 (6) | 22 | 0.7 | (31) | 0.3 | (13) | 0.50 (11) |
| PTA_2675.c1 | (15) 0.69 (9) | 21 | 0.48 | (20) | 0.52 | (22) | 0.67 (14) |
| PTA_275.c2 | (4) 0.44 (4) | 22 | 0.8 | (35) | 0.2 | (9) | 0.36 (8) |
| PTA_276.c1 | (11) 0.21 (3) | 22 | 0.59 | (26) | 0.41 | (18) | 0.27 (6) |
| PTA_286.c1 | (22) 0.29 (4) | 22 | 0.23 | (10) | 0.77 | (34) | 0.27 (6) |
| PTA_423.c1 | (23) 0.21 (3) | 22 | 0.14 | (6) | 0.86 | (38) | 0.18 (4) |
| PTA_449.c1 | (11) 0.21 (3) | 22 | 0.61 | (27) | 0.39 | (17) | 0.23 (5) |
| PTA_463.c2 | (0) 0.00 (0) | 18 | 1 | (36) | 0 | (0) | 0.00 (0) |
| PTA_624.C1 | (18) 0.50 (6) | 20 | 0.33 | (13) | 0.68 | (27) | 0.45 (9) |
| PTA_657.c2 | (26) 0.20 (2) | 22 | 0.11 | (5) | 0.89 | (39) | 0.23 (5) |
| PTA_703.C2 | (20) 0.00 (0) | 14 | 0 | (0) | 1 | (32) | 0.00 (0) |
| PTA_854.c1 | (4) 0.14 (2) | 22 | 0.77 | (34) | 0.23 | (10) | 0.36 (8) |
| PTA_912.c1 | (18) 0.43 (6) | 21 | 0.33 | (14) | 0.67 | (28) | 0.38 (8) |
| PP_1060.c1 | (15) 0.58 (7) | 20 | 0.43 | (17) | 0.58 | (23) | 0.45 (9) |
| PP_1072.C1 | (16) 0.29 (4) | 22 | 0.36 | (16) | 0.64 | (28) | 0.18 (4) |
| PP_1092.C1 | (20) 0.29 (4) | 21 | 0.21 | (9) | 0.79 | (33) | 0.24 (5) |
| PP_1108.C1 | (11) 0.82 (9) | 18 | 0.55 | (21) | 0.45 | (17) | 0.83 (15) |
| PP_1120.C1 | (23) 0.23 (3) | 21 | 0.07 | (3) | 0.93 | (39) | 0.14 (3) |
| PP_1206.C1 | (15) 0.64 (9) | 22 | 0.48 | (21) | 0.52 | (23) | 0.77 (17) |
| PP_134.C1 | (10) 1.00 (10) | 17 | 0.5 | (17) | 0.5 | (17) | 1.00 (17) |
| PP_161.C1 | (10) 0.50 (4) | 11 | 0.32 | (7) | 0.68 | (15) | 0.45 (5) |
| PP_1657.C1 | (13) 0.50 (5) | 18 | 0.31 | (11) | 0.69 | (25) | 0.50 (9) |

[2] Genotyping results from predicted SNPs is shown, using DNA isolated from NB YC1 and NL YC2 parents. The number of individuals tested (N), proportion of allelic diversity for base 1 and base 2 (% b1 and % b2 respectively) with number of alleles observed indicated in bold, and the observed heterozygosity (hetero. = number of heterozygotes detected, divided by number of individuals typed) at each locus is shown with the number of individuals analysed is indicated in parentheses. Statistics were generated for each of the two populations, NL and NB, and overall.

TABLE 3

Segregation analysis for cod SNPs.[3]

| SNP ID | segregation | N | p (chi2) |
|---|---|---|---|
| PTA_276.C1 | irregular | | |
| PTA_423.C1 | irregular | | |
| PTA_275.C2 | irregular | | |
| PTA_449.C1 | irregular | | |
| PP_1108.C1* | irregular | | |
| PP_134.C1* | duplicated | | |
| PP_161.C1* | duplicated | | |
| PTA_463.C2 | monomorphic | | |
| PTA_703.C2 | monomorphic | | |
| PTA_079.C1 | monomorphic | | |
| PTA_1522.C1 | not informative | 6 | 1 |
| PP_1060.C1* | Yes | 44 | 0.132 |
| PP_1072.C1* | Yes | 43 | 0.010 |
| PP_1092.C1* | Yes | 44 | 0.768 |

TABLE 3-continued

Segregation analysis for cod SNPs.[3]

| SNP ID | segregation | N | p (chi2) |
|---|---|---|---|
| PP__1120.C1* | Yes | 36 | 0.739 |
| PP__1206.C1* | Yes | 45 | 0.881 |
| PP__1657.C1* | Yes | 44 | 0.035 |
| PTA__1090.C1 | Yes | 34 | 0.17 |
| PTA__1153.C1 | Yes | 46 | 0.404 |
| PTA__1435.C1 | Yes | 42 | 0.67 |
| PTA__1473.C1 | Yes | 38 | 0.746 |
| PTA__153.C1 | Yes | 43 | 0.093 |
| PTA__1641.C1 | Yes | 44 | 0.546 |
| PTA__1764.C1 | Yes | 43 | 0.286 |
| PTA__179.C1 | Yes | 46 | 0.003 |
| PTA__18.C2 | Yes | 39 | 0.872 |
| PTA__2083.C2 | Yes | 46 | 0.376 |
| PTA__2675.C1 | Yes | 46 | 0.768 |
| PTA__286.C1 | Yes | 44 | 0.763 |
| PTA__624.C1 | Yes | 44 | 0.366 |
| PTA__657.C2 | Yes | 31 | 0.048 |
| PTA__854.C1 | Yes | 40 | 0.343 |
| PTA__912.C1 | Yes | 42 | 0.03 |

[3]"Irregular" indicated that the SNPs did not segregated as expected, "duplicated" indicated that these putative SNPs are most likely to represent a gene duplication. "Not informative" indicates that for this SNP both parents were homozygous for a different allele therefore segregation could not be tested. For SNPs that segregated as expected ("yes'), the number of progeny tested (N), and the probability of $\chi^2$ test of a distortion (p (chi2)) are indicated.

TABLE 4

Annotation of validated SNP-containing sequences.[4]

| SNP ID | length | accession | annotation | Bit score | e-value | identity |
|---|---|---|---|---|---|---|
| PP__1657.C1* | 1194 | BAE45262 | anserinase | 804 | 8e-84 | 82% (148/180) |
| PP__1092.C1* | 1525 | NP__997853 | Cathepsin H; | 1206 | 1e-130 | 67% (216/322) |
| PP__1072.C1* | 1612 | tpe|CAK26786.1| | Transposase domain-containing protein | 641 | 3e-79 | 37% (149/396) |
| PP__1120.C1* | 1431 | NP__001002169 | spermidine/spermine N1-acetyltransferase | 748 | 3e-77 | 83% (141/169) |
| PTA__624.C1 | 689 | AAT45249.1 | unknown [*Sparus aurata*] | 64 | 8e-09 | 45% (30/66) |
| PTA__1473.C1 | 699 | BAF45896 | ribosomal protein S8 [*Solea senegalensis*] | 974 | 1e-104 | 87% (182/208) |
| PTA__1153.C1 | 863 | ABD60150 | interferon stimulated gene 15 | 675 | 2e-69 | 99% (134/135) |
| PTA__2083.C2 | 1694 | NP__956144 | c20orf24 homolog | 605 | 2e-60 | 86% (110/127) |
| PTA__179.C1 | 823 | NP__001072618 | cystinosis, nephropathic [*Xenopus tropicalis*] | 623 | 4e-63 | 70% (117/167) |
| PTA__18.C2 | 1325 | NP__956394 | putative growth hormone like protein-1, yghl1 | 372 | 1e-33 | 81% (70/86) |
| PTA__1764.C1 | 854 | NP__775331 | epididymal secretory protein E1 | 593 | 1e-59 | 70% (105/149) |
| PTA__1090.C1 | 1683 | XP__513647 | to WWFQ154 isoform 8 | 656 | 2e-66 | 50% (126/250) |
| PTA__854.C1 | 1522 | NP__999939 | tetraspanin 7 | 783 | 2e-92 | 69% (154/223) |
| PTA__703.C2 | 909 | AAW29025 | Superoxide dismutase [Cu—Zn]; | 699 | 8e-72 | 83% (127/152) |

[4]Length of the contig from which the SNPs was identified, accession number, bit score, e-value and percentage identity for the BLAST hit are indicated.
*indicates SNPs which were detected by the automated pipeline.

TABLE 5

SNPs location in the gene region and putative SNP functionality (non synonymous or synonymous change).[5]

| SNP ID | Region | SNP effect |
|---|---|---|
| PP__1060.C1* | untranslated region | |
| PP__1072.C1* | untranslated region | |
| PP__1092.C1* | untranslated region | |
| PP__1120.C1* | untranslated region | |
| PTA__1764.C1 | untranslated region | |
| PTA__179.C1 | untranslated region | |
| PTA__463.C2 | untranslated region | |
| PTA__703.C2 | untranslated region | |
| PTA__854.C1 | untranslated region | |
| PTA__1153.C1 | protein coding region | syn |
| PTA__1473.C1 | protein coding region | syn |
| PTA__1090.C1 | protein coding region | non-syn |
| PTA__624.C1 | protein coding region | non-syn |

[5]*indicates SNPs detected by the automated pipeline

TABLE 6

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP__Name | New name | V | P | Score |
|---|---|---|---|---|---|
| 1 | 7438C1CO1.456 | cgpGmo-S10 | | 1 | 0.767 |
| 2 | 6146C1CO1.803 | cgpGmo-S100 | | 1 | 0.571 |
| 3 | 8175C1CO1.190 | cgpGmo-S1000 | | 1 | 0.91 |
| 4 | 8198C1CO1.675 | cgpGmo-S1001 | V | 1 | 0.747 |
| 5 | 8200C1CO1.691 | cgpGmo-S1002 | | 1 | 0.707 |
| 6 | 8211C1CO1.404 | cgpGmo-S1003 | V | 1 | 0.628 |
| 7 | 8217C1CO1.286 | cgpGmo-S1004 | | 1 | 0.827 |
| 8 | 821C1CO1.206 | cgpGmo-S1005 | V | 1 | 0.634 |
| 9 | 8237C1CO1.655 | cgpGmo-S1006 | V | 1 | 0.823 |
| 10 | 8243C1CO1.596 | cgpGmo-S1007 | V | 1 | 0.776 |
| 11 | 8248C1CO1.563 | cgpGmo-S1008 | V | 1 | 0.811 |
| 12 | 8254C1CO1.838 | cgpGmo-S1009 | V | 1 | 0.897 |
| 13 | 7089C1CO1.567 | cgpGmo-S101 | | 1 | 0.898 |
| 14 | 825C2CO1.632 | cgpGmo-S1010 | V | 1 | 0.907 |
| 15 | 829C1CO1.285 | cgpGmo-S1011a | V | 2 | 0.9 |
| 16 | 829C1CO1.716 | cgpGmo-S1011b | V | 1 | 0.8 |
| 17 | 8319C1CO1.383 | cgpGmo-S1012 | | 1 | 0.875 |
| 18 | 832C1CO1.98 | cgpGmo-S1013 | V | 1 | 0.794 |
| 19 | 8332C1CO1.229 | cgpGmo-S1014a | V | 2 | 0.94 |
| 20 | 8332C1CO1.325 | cgpGmo-S1014b | V | 1 | 0.596 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 21 | 834C1CO1.125 | cgpGmo-S1015 | | 1 | 0.828 |
| 22 | 8355C1CO1.403 | cgpGmo-S1016 | V | 1 | 0.707 |
| 23 | 8362C1CO1.579 | cgpGmo-S1017 | V | 1 | 0.883 |
| 24 | 8377C1CO1.271 | cgpGmo-S1018a | V | 2 | 0.95 |
| 25 | 8377C1CO1.540 | cgpGmo-S1018b | V | 1 | 0.805 |
| 26 | 8394C1CO1.538 | cgpGmo-S1019 | | 1 | 0.827 |
| 27 | 7113C2CO1.617 | cgpGmo-S102 | V | 1 | 0.739 |
| 28 | 8436C1CO1.307 | cgpGmo-S1020 | | 1 | 0.713 |
| 29 | 843C1CO1.468 | cgpGmo-S1022 | V | 1 | 0.524 |
| 30 | 8462C1CO1.261 | cgpGmo-S1023 | | 1 | 0.781 |
| 31 | 8467C1CO1.305 | cgpGmo-S1024 | V | 1 | 0.733 |
| 32 | 8473C1CO1.538 | cgpGmo-S1025 | V | 1 | 0.718 |
| 33 | 849C1CO1.1197 | cgpGmo-S1026 | V | 1 | 0.698 |
| 34 | 852C1CO1.135 | cgpGmo-S1027 | V | 1 | 0.683 |
| 35 | 8542C1CO1.578 | cgpGmo-S1028 | V | 1 | 0.795 |
| 36 | 8544C1CO1.224 | cgpGmo-S1029 | V | 1 | 0.823 |
| 37 | 727C1CO1.856 | cgpGmo-S103 | V | 1 | 0.875 |
| 38 | 8558C1CO1.691 | cgpGmo-S1030 | V | 1 | 0.734 |
| 39 | 8574C1CO1.147 | cgpGmo-S1031 | V | 1 | 0.761 |
| 40 | 8590C1CO1.487 | cgpGmo-S1032 | V | 1 | 0.731 |
| 41 | 859C1CO1.398 | cgpGmo-S1033a | | 1 | 0.906 |
| 42 | 859C1CO1.587 | cgpGmo-S1033b | | 2 | 0.98 |
| 43 | 85C1CO1.261 | cgpGmo-S1034 | V | 1 | 0.571 |
| 44 | 8612C1CO1.416 | cgpGmo-S1035 | V | 1 | 0.669 |
| 45 | 8660C1CO1.346 | cgpGmo-S1036 | V | 1 | 0.787 |
| 46 | 8671C1CO1.75 | cgpGmo-S1037 | | 1 | 0.68 |
| 47 | 867C2CO1.568 | cgpGmo-S1038 | V | 1 | 0.667 |
| 48 | 8727C1CO1.363 | cgpGmo-S1039a | V | 2 | 0.88 |
| 49 | 8727C1CO1.443 | cgpGmo-S1039b | V | 1 | 0.567 |
| 50 | 7295C1CO1.177 | cgpGmo-S104 | V | 1 | 0.652 |
| 51 | 8760C1CO1.282 | cgpGmo-S1040 | | 1 | 0.613 |
| 52 | 8812C1CO1.226 | cgpGmo-S1041 | V | 1 | 0.817 |
| 53 | 8813C1CO1.178 | cgpGmo-S1042a | V | 2 | 0.98 |
| 54 | 8813C1CO1.456 | cgpGmo-S1042b | V | 1 | 0.774 |
| 55 | 8822C1CO1.155 | cgpGmo-S1043 | | 1 | 0.428 |
| 56 | 8831C1CO1.119 | cgpGmo-S1044 | V | 1 | 0.893 |
| 57 | 8852C2CO1.180 | cgpGmo-S1045 | V | 1 | 0.844 |
| 58 | 8858C1CO1.415 | cgpGmo-S1046 | V | 1 | 0.804 |
| 59 | 8868C1CO1.320 | cgpGmo-S1047 | V | 1 | 0.86 |
| 60 | 886C1CO1.713 | cgpGmo-S1048 | V | 1 | 0.788 |
| 61 | 8876C1CO1.97 | cgpGmo-S1049 | V | 1 | 0.914 |
| 62 | 7360C1CO1.276 | cgpGmo-S105 | V | 1 | 0.761 |
| 63 | 8898C1CO1.316 | cgpGmo-S1050 | V | 1 | 0.732 |
| 64 | 8907C1CO1.624 | cgpGmo-S1051 | V | 1 | 0.416 |
| 65 | 8916C1CO1.482 | cgpGmo-S1052 | | 1 | 0.901 |
| 66 | 896C1CO1.240 | cgpGmo-S1053 | | 1 | 0.871 |
| 67 | 8982C1CO1.388 | cgpGmo-S1054 | | 1 | 0.902 |
| 68 | 898C1CO1.194 | cgpGmo-S1055a | V | 1 | 0.851 |
| 69 | 898C1CO1.501 | cgpGmo-S1055b | V | 2 | 0.97 |
| 70 | 9008C1CO1.522 | cgpGmo-S1056 | | 1 | 0.884 |
| 71 | 9043C1CO1.444 | cgpGmo-S1057a | V | 2 | 1 |
| 72 | 9043C1CO1.620 | cgpGmo-S1057b | | 1 | 0.81 |
| 73 | 9048C1CO1.568 | cgpGmo-S1058 | V | 1 | 0.852 |
| 74 | 9055C1CO1.289 | cgpGmo-S1059 | | 1 | 0.775 |
| 75 | 9106C1CO1.388 | cgpGmo-S1060 | | 1 | 0.823 |
| 76 | 910C1CO1.632 | cgpGmo-S1061 | | 1 | 0.724 |
| 77 | 913C2CO1.505 | cgpGmo-S1062 | V | 1 | 0.639 |
| 78 | 9143C1CO1.292 | cgpGmo-S1063 | V | 1 | 0.862 |
| 79 | 9148C1CO1.367 | cgpGmo-S1064 | | 1 | 0.816 |
| 80 | 915C1CO1.601 | cgpGmo-S1065 | V | 1 | 0.814 |
| 81 | 917C1CO1.115 | cgpGmo-S1066 | V | 1 | 0.718 |
| 82 | 9216C1CO1.189 | cgpGmo-S1067 | | 1 | 0.818 |
| 83 | 9225C1CO1.510 | cgpGmo-S1068 | V | 1 | 0.883 |
| 84 | 922C1CO1.257 | cgpGmo-S1069 | | 1 | 0.901 |
| 85 | 7514C1CO1.267 | cgpGmo-S107 | V | 1 | 0.732 |
| 86 | 9239C1CO1.594 | cgpGmo-S1070 | V | 1 | 0.893 |
| 87 | 9244C1CO1.298 | cgpGmo-S1071a | | 1 | 0.821 |
| 88 | 9244C1CO1.505 | cgpGmo-S1071b | | 2 | 0.86 |
| 89 | 9304C1CO1.479 | cgpGmo-S1072 | | 1 | 0.741 |
| 90 | 9355C1CO1.388 | cgpGmo-S1073 | V | 1 | 0.876 |
| 91 | 9356C1CO1.1059 | cgpGmo-S1074 | V | 1 | 0.857 |
| 92 | 935C1CO1.464 | cgpGmo-S1075 | V | 1 | 0.797 |
| 93 | 9379C1CO1.272 | cgpGmo-S1076a | V | 1 | 0.775 |
| 94 | 9379C1CO1.565 | cgpGmo-S1076b | V | 2 | 0.95 |
| 95 | 943C2CO1.170 | cgpGmo-S1077a | | 2 | 0.87 |
| 96 | 943C2CO1.474 | cgpGmo-S1077b | V | 1 | 0.615 |
| 97 | 947C3CO1.272 | cgpGmo-S1078 | V | 1 | 0.694 |
| 98 | 9484C1CO1.708 | cgpGmo-S1079 | V | 1 | 0.712 |
| 99 | 7521C1CO1.633 | cgpGmo-S108 | V | 1 | 0.794 |
| 100 | 9490C1CO1.438 | cgpGmo-S1080 | V | 1 | 0.619 |
| 101 | 949C1CO1.904 | cgpGmo-S1081 | V | 1 | 0.768 |
| 102 | 9502C1CO1.395 | cgpGmo-S1082 | V | 1 | 0.873 |
| 103 | 9503C1CO1.249 | cgpGmo-S1083 | V | 1 | 0.802 |
| 104 | 9504C1CO1.397 | cgpGmo-S1084 | V | 1 | 0.697 |
| 105 | 952C1CO1.176 | cgpGmo-S1085a | V | 1 | 0.816 |
| 106 | 952C1CO1.299 | cgpGmo-S1085b | V | 2 | 0.89 |
| 107 | 9543C1CO1.323 | cgpGmo-S1086 | V | 1 | 0.76 |
| 108 | 95C1CO1.158 | cgpGmo-S1087a | | 2 | 0.86 |
| 109 | 95C1CO1.548 | cgpGmo-S1087b | V | 1 | 0.679 |
| 110 | 9612C1CO1.594 | cgpGmo-S1088 | | 1 | 0.725 |
| 111 | 9615C1CO1.381 | cgpGmo-S1089 | V | 1 | 0.771 |
| 112 | 7616C1CO1.612 | cgpGmo-S109 | V | 1 | 0.646 |
| 113 | 962C3CO1.584 | cgpGmo-S1090 | V | 1 | 0.786 |
| 114 | 9642C1CO1.154 | cgpGmo-S1091 | V | 1 | 0.914 |
| 115 | 9671C1CO1.293 | cgpGmo-S1092a | V | 2 | 0.96 |
| 116 | 9671C1CO1.624 | cgpGmo-S1092b | | 1 | 0.738 |
| 117 | 9682C1CO1.765 | cgpGmo-S1093 | V | 1 | 0.895 |
| 118 | 9683C2CO1.587 | cgpGmo-S1094 | V | 1 | 0.864 |
| 119 | 968C1CO1.536 | cgpGmo-S1095 | V | 1 | 0.878 |
| 120 | 9710C1CO1.403 | cgpGmo-S1096 | V | 1 | 0.671 |
| 121 | 9732C1CO1.311 | cgpGmo-S1097 | V | 1 | 0.52 |
| 122 | 9755C1CO1.874 | cgpGmo-S1098 | V | 1 | 0.78 |
| 123 | 7696C1CO1.426 | cgpGmo-S110 | V | 1 | 0.647 |
| 124 | 9801C1CO1.287 | cgpGmo-S1101a | V | 1 | 0.865 |
| 125 | 9801C1CO1.431 | cgpGmo-S1101b | | 2 | 0.96 |
| 126 | 985C1CO1.97 | cgpGmo-S1102a | | 2 | 0.78 |
| 127 | 985C1CO1.521 | cgpGmo-S1102b | | 1 | 0.458 |
| 128 | 9860C1CO1.509 | cgpGmo-S1103 | V | 1 | 0.91 |
| 129 | 988C2CO1.100 | cgpGmo-S1104 | V | 1 | 0.84 |
| 130 | 9900C2CO1.72 | cgpGmo-S1105 | V | 1 | 0.789 |
| 131 | 990C1CO1.966 | cgpGmo-S1106 | V | 1 | 0.836 |
| 132 | 9924C1CO1.329 | cgpGmo-S1107 | V | 1 | 0.874 |
| 133 | 993C1CO1.498 | cgpGmo-S1108 | V | 1 | 0.908 |
| 134 | 996C1CO1.70 | cgpGmo-S1109 | | 1 | 0.907 |
| 135 | 9977C1CO1.83 | cgpGmo-S1110 | V | 1 | 0.811 |
| 136 | 1beta1139 | cgpGmo-S1111 | V | 2 | 0.625 |
| 137 | 1beta68 | cgpGmo-S1112 | V | 2 | 0.787 |
| 138 | 1beta787 | cgpGmo-S1113 | V | 2 | 0.703 |
| 139 | 3beta115 | cgpGmo-S1114 | | 2 | 0.535 |
| 140 | 3beta369 | cgpGmo-S1115 | V | 2 | 0.839 |
| 141 | 3beta431 | cgpGmo-S1116 | V | 2 | 0.623 |
| 142 | 3beta670 | cgpGmo-S1117 | V | 2 | 0.722 |
| 143 | all_v2.10471.C1.580 | cgpGmo-S1118 | | 2 | 0.922 |
| 144 | all_v2.10472.C1.668 | cgpGmo-S1119 | | 2 | 0.552 |
| 145 | 7699C1CO1.486 | cgpGmo-S111a | V | 1 | 0.701 |
| 146 | 7699C1CO1.588 | cgpGmo-S111b | V | 2 | 0.73 |
| 147 | 7875C1CO1.273 | cgpGmo-S112 | | 1 | 0.51 |
| 148 | all_v2.10762.C1.327 | cgpGmo-S1120 | | 2 | 0.835 |
| 149 | all_v2.1182.C3.404 | cgpGmo-S1121 | V | 2 | 0.902 |
| 150 | all_v2.1240.C2.204 | cgpGmo-S1122 | V | 2 | 0.84 |
| 151 | all_v2.12584.C1.552 | cgpGmo-S1123 | V | 2 | 0.957 |
| 152 | all_v2.12816.C1.280 | cgpGmo-S1124 | | 2 | 0.894 |
| 153 | all_v2.14.C3.218 | cgpGmo-S1125 | | 2 | 0.981 |
| 154 | all_v2.14470.C1.513 | cgpGmo-S1126 | V | 2 | 0.597 |
| 155 | all_v2.1580.C2.665 | cgpGmo-S1127 | V | 2 | 0.98 |
| 156 | all_v2.16284.C1.608 | cgpGmo-S1128 | | 2 | 0.83 |
| 157 | all_v2.1631.C3.376 | cgpGmo-S1129 | | 2 | 0.958 |
| 158 | 7910C1CO1.596 | cgpGmo-S113 | V | 1 | 0.815 |
| 159 | all_v2.17178.C1.707 | cgpGmo-S1130 | V | 2 | 0.888 |
| 160 | all_v2.1745.C2.198 | cgpGmo-S1131 | V | 2 | 0.935 |
| 161 | all_v2.1778.C1.1202 | cgpGmo-S1132 | | 2 | 0.829 |
| 162 | all_v2.1873.C1.764 | cgpGmo-S1133 | | 2 | 0.901 |
| 163 | all_v2.2218.C1.642 | cgpGmo-S1134 | | 2 | 0.933 |
| 164 | all_v2.2386.C1.119 | cgpGmo-S1135 | | 2 | 0.984 |
| 165 | all_v2.2387.C4.359 | cgpGmo-S1136 | | 2 | 0.958 |
| 166 | all_v2.2487.C3.177 | cgpGmo-S1137 | | 2 | 0.956 |
| 167 | all_v2.269.C1.748 | cgpGmo-S1138 | | 2 | 0.939 |
| 168 | all_v2.3115.C1.694 | cgpGmo-S1139 | | 2 | 0.812 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 169 | 8067C1CO1.557 | cgpGmo-S114 | V | 1 | 0.889 |
| 170 | all_v2.3403.C1.693 | cgpGmo-S1140 | V | 2 | 0.762 |
| 171 | all_v2.37.C2.558 | cgpGmo-S1141 |  | 2 | 0.97 |
| 172 | all_v2.4.C42.1238 | cgpGmo-S1142 | V | 2 | 0.66 |
| 173 | all_v2.4620.C1.743 | cgpGmo-S1143 |  | 2 | 0.688 |
| 174 | all_v2.486.C40.439 | cgpGmo-S1144 |  | 2 | 0.847 |
| 175 | all_v2.495.C1.1115 | cgpGmo-S1145 |  | 2 | 0.738 |
| 176 | all_v2.5424.C1.660 | cgpGmo-S1146 |  | 2 | 0.832 |
| 177 | all_v2.5532.C1.215 | cgpGmo-S1147 |  | 2 | 0.789 |
| 178 | all_v2.6979.C2.795 | cgpGmo-S1148 |  | 2 | 0.753 |
| 179 | all_v2.838.C3.137 | cgpGmo-S1149 |  | 2 | 0.913 |
| 180 | 8428C1CO1.521 | cgpGmo-S115 | V | 1 | 0.517 |
| 181 | all_v2.8471.C1.373 | cgpGmo-S1150 |  | 2 | 0.477 |
| 182 | all_v2.8613.C2.690 | cgpGmo-S1151 |  | 2 | 0.888 |
| 183 | all_v2.8695.C1.117 | cgpGmo-S1152 |  | 2 | 0.726 |
| 184 | all_v2.871.C1.415 | cgpGmo-S1153 |  | 2 | 0.972 |
| 185 | all_v2.8751.C1.210 | cgpGmo-S1154 |  | 2 | 0.929 |
| 186 | all_v2.9258.C1.246 | cgpGmo-S1155 |  | 2 | 0.764 |
| 187 | all_v2.93.C4.268 | cgpGmo-S1156 |  | 2 | 0.708 |
| 188 | all_v2.9521.C1.369 | cgpGmo-S1157 | V | 2 | 0.882 |
| 189 | all_v2.9596.C1.244 | cgpGmo-S1158 | V | 2 | 0.899 |
| 190 | all_v2.9973.C2.356 | cgpGmo-S1159 |  | 2 | 0.346 |
| 191 | 919C1CO1.212 | cgpGmo-S116 | V | 1 | 0.876 |
| 192 | 101C1CO1.258 | cgpGmo-S1162 | V | 2 | 0.92 |
| 193 | 1023C3CO1.295 | cgpGmo-S1163 | V | 2 | 0.94 |
| 194 | 10303C1CO1.348 | cgpGmo-S1164 |  | 2 | 0.89 |
| 195 | 1038C1CO1.319 | cgpGmo-S1166 | V | 2 | 0.75 |
| 196 | 10392C1CO2.1102 | cgpGmo-S1167 | V | 2 | 0.94 |
| 197 | 10574C1CO1.258 | cgpGmo-S1169 | V | 2 | 0.67 |
| 198 | 9346C1CO1.100 | cgpGmo-S117 |  | 1 | 0.785 |
| 199 | 10591C2CO1.420 | cgpGmo-S1170 |  | 2 | 0.62 |
| 200 | 10639C1CO1.217 | cgpGmo-S1171 |  | 2 | 0.92 |
| 201 | 1093C1CO1.226 | cgpGmo-S1172 | V | 2 | 0.67 |
| 202 | 1105C1CO1.668 | cgpGmo-S1175 |  | 2 | 0.79 |
| 203 | 110C1CO1.986 | cgpGmo-S1176 |  | 2 | 0.9 |
| 204 | 1125C1CO1.153 | cgpGmo-S1178 | V | 2 | 0.93 |
| 205 | 11264C1CO1.589 | cgpGmo-S1179 | V | 2 | 0.89 |
| 206 | 9565C1CO1.422 | cgpGmo-S118 |  | 1 | 0.76 |
| 207 | 11275C1CO1.351 | cgpGmo-S1180a |  | 2 | 0.86 |
| 208 | 11275C1CO1.463 | cgpGmo-S1180b |  | 2 | 0.83 |
| 209 | 1140C1CO1.1290 | cgpGmo-S1181 | V | 2 | 0.88 |
| 210 | 1158C1CO1.535 | cgpGmo-S1183 | V | 2 | 0.9 |
| 211 | 1160C1CO1.270 | cgpGmo-S1184 | V | 2 | 0.69 |
| 212 | 1163C1CO1.148 | cgpGmo-S1185 |  | 2 | 0.99 |
| 213 | 1170C1CO1.461 | cgpGmo-S1186 | V | 2 | 0.75 |
| 214 | 11840C1CO1.475 | cgpGmo-S1188 | V | 2 | 0.96 |
| 215 | 1213C1CO1.742 | cgpGmo-S1190 |  | 2 | 0.94 |
| 216 | 1257C1CO1.412 | cgpGmo-S1192 |  | 2 | 0.97 |
| 217 | 1259C2CO1.765 | cgpGmo-S1193 | V | 2 | 0.95 |
| 218 | 1274C3CO1.192 | cgpGmo-S1196a | V | 2 | 0.97 |
| 219 | 1274C3CO1.269 | cgpGmo-S1196b | V | 2 | 0.99 |
| 220 | 1275C1CO1.99 | cgpGmo-S1197a | V | 2 | 0.76 |
| 221 | 1275C1CO1.229 | cgpGmo-S1197b |  | 2 | 0.7 |
| 222 | 972C1CO1.421 | cgpGmo-S119a | V | 1 | 0.649 |
| 223 | 972C1CO1.540 | cgpGmo-S119b | V | 2 | 0.88 |
| 224 | 10001C1CO1.183 | cgpGmo-S120 | V | 1 | 0.629 |
| 225 | 1310C1CO1.339 | cgpGmo-S1200 |  | 2 | 0.97 |
| 226 | 1413C1CO1.696 | cgpGmo-S1201 |  | 2 | 0.95 |
| 227 | 1419C1CO1.602 | cgpGmo-S1202 |  | 2 | 0.96 |
| 228 | 1452C3CO1.125 | cgpGmo-S1204 | V | 2 | 0.98 |
| 229 | 1461C1CO1.559 | cgpGmo-S1205 | V | 2 | 0.93 |
| 230 | 1467C2CO1.417 | cgpGmo-S1206 |  | 2 | 0.94 |
| 231 | 1494C1CO1.446 | cgpGmo-S1208 |  | 2 | 0.92 |
| 232 | 1497C1CO1.102 | cgpGmo-S1209 | V | 2 | 0.96 |
| 233 | 1000C1CO1.595 | cgpGmo-S121 | V | 1 | 0.868 |
| 234 | 1555C1CO1.1236 | cgpGmo-S1212 |  | 2 | 0.98 |
| 235 | 1557C1CO1.474 | cgpGmo-S1213a |  | 2 | 0.94 |
| 236 | 1557C1CO1.325 | cgpGmo-S1213b |  | 1 | 0.847 |
| 237 | 1557C1CO1.255 | cgpGmo-S1213c | V | 2 | 0.94 |
| 238 | 157C2CO1.576 | cgpGmo-S1216a | V | 2 | 0.9 |
| 239 | 157C2CO1.849 | cgpGmo-S1216b |  | 2 | 0.98 |
| 240 | 157C3CO1.630 | cgpGmo-S1217 |  | 2 | 0.96 |
| 241 | 1583C1CO1.958 | cgpGmo-S1218 | V | 2 | 0.97 |
| 242 | 1589C1CO1.67 | cgpGmo-S1219a | V | 2 | 0.6 |
| 243 | 1589C1CO1.147 | cgpGmo-S1219b | V | 2 | 0.7 |
| 244 | 1589C1CO1.288 | cgpGmo-S1219c | V | 1 | 0.503 |
| 245 | 10037C1CO1.421 | cgpGmo-S122 | V | 1 | 0.639 |
| 246 | 1598C1CO1.204 | cgpGmo-S1221a | V | 2 | 0.97 |
| 247 | 1598C1CO1.273 | cgpGmo-S1221b | V | 2 | 0.93 |
| 248 | 1601C1CO1.574 | cgpGmo-S1222 | V | 2 | 0.92 |
| 249 | 1618C1CO1.292 | cgpGmo-S1224 | V | 2 | 0.92 |
| 250 | 1645C1CO1.315 | cgpGmo-S1225 | V | 2 | 0.97 |
| 251 | 1649C4CO1.991 | cgpGmo-S1226 | V | 2 | 0.95 |
| 252 | 1681C2CO1.275 | cgpGmo-S1230a | V | 1 | 0.893 |
| 253 | 1681C2CO1.506 | cgpGmo-S1230b |  | 2 | 0.95 |
| 254 | 172C1CO1.454 | cgpGmo-S1231 | V | 2 | 0.67 |
| 255 | 1741C1CO1.290 | cgpGmo-S1232 | V | 2 | 0.85 |
| 256 | 1790C1CO1.552 | cgpGmo-S1234 | V | 2 | 0.81 |
| 257 | 1802C1CO1.342 | cgpGmo-S1235 | V | 2 | 0.83 |
| 258 | 1808C1CO1.373 | cgpGmo-S1236a |  | 2 | 0.99 |
| 259 | 1808C1CO1.602 | cgpGmo-S1236b |  | 2 | 0.96 |
| 260 | 1824C1CO1.199 | cgpGmo-S1237 | V | 2 | 0.91 |
| 261 | 1860C1CO1.159 | cgpGmo-S1239 | V | 2 | 0.91 |
| 262 | 10053C1CO1.358 | cgpGmo-S123a |  | 2 | 0.68 |
| 263 | 10053C1CO1.491 | cgpGmo-S123b |  | 1 | 0.603 |
| 264 | 10078C1CO1.320 | cgpGmo-S124 | V | 1 | 0.903 |
| 265 | 1890C1CO1.700 | cgpGmo-S1241 | V | 2 | 0.98 |
| 266 | 1898C1CO1.530 | cgpGmo-S1242 | V | 2 | 0.59 |
| 267 | 1933C2CO1.182 | cgpGmo-S1243a | V | 2 | 0.89 |
| 268 | 1933C2CO1.246 | cgpGmo-S1243b | V | 2 | 0.86 |
| 269 | 1008C1CO1.620 | cgpGmo-S125 |  | 1 | 0.591 |
| 270 | 2058C1CO1.325 | cgpGmo-S1250 |  | 2 | 0.93 |
| 271 | 2067C1CO1.438 | cgpGmo-S1251 | V | 2 | 0.83 |
| 272 | 2091C2CO1.488 | cgpGmo-S1252 | V | 2 | 0.98 |
| 273 | 2107C2CO1.395 | cgpGmo-S1255a | V | 2 | 0.8 |
| 274 | 2107C2CO1.110 | cgpGmo-S1255b | V | 2 | 0.94 |
| 275 | 2125C2CO1.134 | cgpGmo-S1256a | V | 2 | 0.93 |
| 276 | 2125C2CO1.377 | cgpGmo-S1256b | V | 2 | 0.95 |
| 277 | 2143C1CO1.182 | cgpGmo-S1258a | V | 2 | 0.92 |
| 278 | 2143C1CO1.548 | cgpGmo-S1258b | V | 2 | 0.93 |
| 279 | 2161C1CO1.347 | cgpGmo-S1260 | V | 2 | 0.71 |
| 280 | 220C1CO1.497 | cgpGmo-S1263 | V | 2 | 0.91 |
| 281 | 2244C1CO1.338 | cgpGmo-S1265a | V | 1 | 0.528 |
| 282 | 2244C1CO1.460 | cgpGmo-S1265b | V | 2 | 0.87 |
| 283 | 2244C1CO1.658 | cgpGmo-S1265c | V | 2 | 0.96 |
| 284 | 2261C1CO1.466 | cgpGmo-S1267 |  | 2 | 0.96 |
| 285 | 2282C1CO1.237 | cgpGmo-S1268 | V | 2 | 0.9 |
| 286 | 2293C1CO1.596 | cgpGmo-S1269 | V | 2 | 0.97 |
| 287 | 1011C1CO1.158 | cgpGmo-S126a | V | 2 | 0.97 |
| 288 | 1011C1CO1.430 | cgpGmo-S126b | V | 1 | 0.821 |
| 289 | 10152C1CO1.625 | cgpGmo-S127 | V | 1 | 0.896 |
| 290 | 2311C1CO1.190 | cgpGmo-S1270 |  | 2 | 0.91 |
| 291 | 2330C1CO1.269 | cgpGmo-S1272 | V | 2 | 0.88 |
| 292 | 2337C1CO1.284 | cgpGmo-S1273 | V | 2 | 0.84 |
| 293 | 2357C2CO1.233 | cgpGmo-S1274 |  | 2 | 0.73 |
| 294 | 2380C1CO1.258 | cgpGmo-S1276a | V | 2 | 0.69 |
| 295 | 2380C1CO1.675 | cgpGmo-S1276b |  | 1 | 0.662 |
| 296 | 2432C1CO1.213 | cgpGmo-S1278 | V | 2 | 0.92 |
| 297 | 2442C1CO1.490 | cgpGmo-S1279 | V | 2 | 0.48 |
| 298 | 2463C3CO1.462 | cgpGmo-S1280 | V | 2 | 0.93 |
| 299 | 2471C2CO1.537 | cgpGmo-S1281 | V | 2 | 0.74 |
| 300 | 2523C1CO1.535 | cgpGmo-S1283 |  | 2 | 0.93 |
| 301 | 252C1CO1.574 | cgpGmo-S1284 | V | 2 | 0.98 |
| 302 | 2568C2CO1.388 | cgpGmo-S1287 | V | 2 | 1 |
| 303 | 2577C1CO1.355 | cgpGmo-S1288 |  | 2 | 0.81 |
| 304 | 101C3CO1.99 | cgpGmo-S129 | V | 1 | 0.823 |
| 305 | 2581C2CO1.625 | cgpGmo-S1290 | V | 2 | 0.79 |
| 306 | 262C1CO1.163 | cgpGmo-S1291 | V | 2 | 0.93 |
| 307 | 2660C1CO1.418 | cgpGmo-S1294 | V | 2 | 0.8 |
| 308 | 268C3CO2.464 | cgpGmo-S1295a |  | 2 | 0.98 |
| 309 | 268C3CO2.740 | cgpGmo-S1295b |  | 2 | 0.94 |
| 310 | 271C1CO1.267 | cgpGmo-S1296 | V | 2 | 0.92 |
| 311 | 2722C1CO1.439 | cgpGmo-S1297a | V | 2 | 0.84 |
| 312 | 2722C2CO1.598 | cgpGmo-S1297b |  | 2 | 0.72 |
| 313 | 2726C1CO1.534 | cgpGmo-S1298 |  | 2 | 0.87 |
| 314 | 10247C1CO1.416 | cgpGmo-S130 | V | 1 | 0.865 |
| 315 | 2744C1CO1.261 | cgpGmo-S1300a | V | 2 | 0.95 |
| 316 | 2744C1CO1.767 | cgpGmo-S1300b |  | 2 | 0.72 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 317 | 2756C2CO1.571 | cgpGmo-S1301 | V | 2 | 0.94 |
| 318 | 2756C4CO1.469 | cgpGmo-S1302 | V | 2 | 0.77 |
| 319 | 2758C1CO1.580 | cgpGmo-S1303 |  | 2 | 0.93 |
| 320 | 276C2CO1.434 | cgpGmo-S1304a | V | 2 | 0.97 |
| 321 | 276C2CO1.504 | cgpGmo-S1304b | V | 2 | 0.92 |
| 322 | 2780C1CO1.510 | cgpGmo-S1305 |  | 2 | 0.85 |
| 323 | 2797C1CO1.633 | cgpGmo-S1306 |  | 2 | 0.91 |
| 324 | 281C2CO1.562 | cgpGmo-S1308 | V | 2 | 0.98 |
| 325 | 1026C2CO1.273 | cgpGmo-S131 |  | 1 | 0.882 |
| 326 | 2881C2CO1.159 | cgpGmo-S1310 | V | 2 | 0.84 |
| 327 | 2898C1CO1.336 | cgpGmo-S1312 | V | 2 | 0.59 |
| 328 | 2929C1CO1.64 | cgpGmo-S1315 | V | 2 | 0.96 |
| 329 | 2940C1CO1.576 | cgpGmo-S1316 | V | 2 | 0.95 |
| 330 | 2952C2CO1.192 | cgpGmo-S1317 |  | 2 | 0.81 |
| 331 | 2988C1CO1.305 | cgpGmo-S1319 |  | 2 | 0.94 |
| 332 | 10285C1CO1.215 | cgpGmo-S132 |  | 1 | 0.815 |
| 333 | 2993C1CO1.495 | cgpGmo-S1320 | V | 2 | 0.91 |
| 334 | 299C1CO1.223 | cgpGmo-S1321 | V | 2 | 0.97 |
| 335 | 3024C2CO1.304 | cgpGmo-S1323 | V | 2 | 0.96 |
| 336 | 3031C1CO1.530 | cgpGmo-S1324 |  | 2 | 0.8 |
| 337 | 3041C3CO1.141 | cgpGmo-S1325a |  | 2 | 0.58 |
| 338 | 3041C3CO1.661 | cgpGmo-S1325b |  | 2 | 0.64 |
| 339 | 3042C1CO1.551 | cgpGmo-S1326 | V | 2 | 0.92 |
| 340 | 3057C1CO1.850 | cgpGmo-S1327a | V | 2 | 0.82 |
| 341 | 3057C1CO1.928 | cgpGmo-S1327b |  | 2 | 0.98 |
| 342 | 3081C1CO1.312 | cgpGmo-S1328 | V | 2 | 0.78 |
| 343 | 3088C1CO1.794 | cgpGmo-S1329 | V | 2 | 0.7 |
| 344 | 10293C1CO1.650 | cgpGmo-S133 | V | 1 | 0.912 |
| 345 | 3099C1CO1.204 | cgpGmo-S1330 |  | 2 | 0.73 |
| 346 | 311C1CO1.517 | cgpGmo-S1331 |  | 2 | 0.91 |
| 347 | 3172C1CO1.116 | cgpGmo-S1332 | V | 2 | 0.93 |
| 348 | 3174C1CO1.162 | cgpGmo-S1333 |  | 2 | 0.89 |
| 349 | 3176C2CO1.333 | cgpGmo-S1334 | V | 2 | 0.72 |
| 350 | 3191C1CO1.397 | cgpGmo-S1335 | V | 2 | 0.92 |
| 351 | 3214C1CO1.85 | cgpGmo-S1336 | V | 2 | 0.93 |
| 352 | 3239C1CO1.514 | cgpGmo-S1337 | V | 2 | 0.92 |
| 353 | 3252C1CO1.148 | cgpGmo-S1338 | V | 2 | 0.76 |
| 354 | 3295C1CO1.390 | cgpGmo-S1339 | V | 2 | 0.84 |
| 355 | 10330C1CO1.584 | cgpGmo-S134 | V | 1 | 0.624 |
| 356 | 3327C1CO1.588 | cgpGmo-S1340 | V | 2 | 0.84 |
| 357 | 3341C1CO1.610 | cgpGmo-S1341 |  | 2 | 0.8 |
| 358 | 3357C1CO1.542 | cgpGmo-S1342 | V | 2 | 0.95 |
| 359 | 33C1CO1.476 | cgpGmo-S1344 | V | 2 | 0.93 |
| 360 | 3411C1CO1.411 | cgpGmo-S1346 | V | 2 | 0.57 |
| 361 | 3418C1CO1.504 | cgpGmo-S1347 | V | 2 | 0.95 |
| 362 | 3420C1CO1.616 | cgpGmo-S1348 |  | 2 | 0.77 |
| 363 | 10340C1CO1.574 | cgpGmo-S135 | V | 1 | 0.604 |
| 364 | 3433C1CO1.513 | cgpGmo-S1350 | V | 2 | 0.65 |
| 365 | 3539C1CO1.797 | cgpGmo-S1354 | V | 2 | 0.91 |
| 366 | 3556C1CO1.522 | cgpGmo-S1355 |  | 2 | 0.84 |
| 367 | 3580C1CO1.179 | cgpGmo-S1357a |  | 2 | 0.92 |
| 368 | 3580C1CO1.451 | cgpGmo-S1357b |  | 2 | 0.43 |
| 369 | 3582C1CO1.307 | cgpGmo-S1358 | V | 2 | 0.96 |
| 370 | 3602C1CO1.568 | cgpGmo-S1359 | V | 2 | 0.87 |
| 371 | 10343C1CO1.545 | cgpGmo-S136 | V | 1 | 0.894 |
| 372 | 3603C1CO1.207 | cgpGmo-S1360a |  | 2 | 0.78 |
| 373 | 3603C1CO1.319 | cgpGmo-S1360b |  | 2 | 0.99 |
| 374 | 3607C2CO1.557 | cgpGmo-S1362 |  | 2 | 0.86 |
| 375 | 3632C1CO1.143 | cgpGmo-S1363 | V | 2 | 0.93 |
| 376 | 3652C2CO1.370 | cgpGmo-S1365a | V | 2 | 0.9 |
| 377 | 3652C2CO1.494 | cgpGmo-S1365b | V | 2 | 0.89 |
| 378 | 3657C2CO1.358 | cgpGmo-S1367a | V | 2 | 0.95 |
| 379 | 3657C2CO1.469 | cgpGmo-S1367b |  | 2 | 0.94 |
| 380 | 3673C1CO1.486 | cgpGmo-S1368 |  | 2 | 0.59 |
| 381 | 3696C1CO1.1386 | cgpGmo-S1369 | V | 2 | 0.96 |
| 382 | 1036C1CO1.238 | cgpGmo-S137 | V | 1 | 0.728 |
| 383 | 3699C2CO1.734 | cgpGmo-S1370 | V | 2 | 0.63 |
| 384 | 36C3CO1.351 | cgpGmo-S1372 |  | 2 | 0.83 |
| 385 | 3716C1CO1.291 | cgpGmo-S1373 | V | 2 | 0.92 |
| 386 | 371C1CO1.180 | cgpGmo-S1374 |  | 2 | 0.86 |
| 387 | 3752C2CO1.448 | cgpGmo-S1376 |  | 2 | 0.98 |
| 388 | 3767C1CO1.577 | cgpGmo-S1377 | V | 2 | 0.9 |
| 389 | 3778C1CO1.166 | cgpGmo-S1378 | V | 2 | 0.96 |
| 390 | 3819C1CO1.92 | cgpGmo-S1379 | V | 2 | 0.91 |
| 391 | 1048C1CO1.744 | cgpGmo-S138 | V | 1 | 0.828 |
| 392 | 3820C1CO1.229 | cgpGmo-S1380 |  | 2 | 0.92 |
| 393 | 3850C1CO1.120 | cgpGmo-S1381 |  | 2 | 0.84 |
| 394 | 3864C1CO1.1100 | cgpGmo-S1382 | V | 2 | 0.99 |
| 395 | 3872C1CO1.504 | cgpGmo-S1384 | V | 2 | 0.91 |
| 396 | 3890C1CO1.337 | cgpGmo-S1385a | V | 2 | 0.99 |
| 397 | 3890C1CO1.552 | cgpGmo-S1385b | V | 2 | 0.95 |
| 398 | 389C9CO1.314 | cgpGmo-S1387a |  | 1 | 0.876 |
| 399 | 389C9CO1.467 | cgpGmo-S1387b |  | 2 | 0.96 |
| 400 | 3933C1CO1.224 | cgpGmo-S1389 |  | 2 | 0.92 |
| 401 | 10521C1CO1.80 | cgpGmo-S139 |  | 1 | 0.774 |
| 402 | 3990C1CO1.240 | cgpGmo-S1390a | V | 2 | 0.97 |
| 403 | 3990C1CO1.411 | cgpGmo-S1390b |  | 2 | 0.99 |
| 404 | 399C4CO1.141 | cgpGmo-S1391 | V | 2 | 0.74 |
| 405 | 399C5CO1.668 | cgpGmo-S1392 |  | 2 | 0.48 |
| 406 | 4037C1CO1.293 | cgpGmo-S1393a | V | 2 | 0.98 |
| 407 | 4037C1CO1.554 | cgpGmo-S1393b | V | 2 | 0.97 |
| 408 | 4048C1CO1.289 | cgpGmo-S1394a | V | 2 | 0.78 |
| 409 | 4048C1CO1.570 | cgpGmo-S1394b | V | 2 | 0.94 |
| 410 | 4076C1CO1.382 | cgpGmo-S1396 |  | 2 | 0.96 |
| 411 | 4096C2CO1.177 | cgpGmo-S1397 | V | 2 | 0.97 |
| 412 | 4113C2CO1.349 | cgpGmo-S1399a | V | 2 | 0.97 |
| 413 | 4113C2CO1.423 | cgpGmo-S1399b | V | 2 | 0.93 |
| 414 | 10465C1CO1.148 | cgpGmo-S13a |  | 1 | 0.875 |
| 415 | 10465C1CO1.547 | cgpGmo-S13b | V | 2 | 0.9 |
| 416 | 452C2CO1.147 | cgpGmo-S14 |  | 1 | 0.437 |
| 417 | 10557C1CO1.376 | cgpGmo-S140 | V | 1 | 0.811 |
| 418 | 4153C2CO1.564 | cgpGmo-S1401 | V | 2 | 0.9 |
| 419 | 4287C1CO1.501 | cgpGmo-S1404 |  | 2 | 0.7 |
| 420 | 4321C1CO1.398 | cgpGmo-S1406 | V | 2 | 0.95 |
| 421 | 4325C1CO1.157 | cgpGmo-S1407 | V | 2 | 0.94 |
| 422 | 432C1CO1.327 | cgpGmo-S1408 | V | 2 | 0.94 |
| 423 | 4354C1CO1.459 | cgpGmo-S1410 | V | 2 | 0.88 |
| 424 | 4377C1CO1.292 | cgpGmo-S1412 | V | 2 | 0.87 |
| 425 | 4387C1CO1.490 | cgpGmo-S1413 |  | 2 | 0.93 |
| 426 | 4457C1CO1.289 | cgpGmo-S1417 | V | 2 | 0.68 |
| 427 | 4471C1CO1.301 | cgpGmo-S1418 | V | 2 | 0.97 |
| 428 | 10580C1CO1.134 | cgpGmo-S142 | V | 1 | 0.639 |
| 429 | 4510C1CO1.286 | cgpGmo-S1421 |  | 2 | 0.9 |
| 430 | 4543C2CO1.545 | cgpGmo-S1423a | V | 2 | 0.97 |
| 431 | 4543C2CO1.672 | cgpGmo-S1423b |  | 1 | 0.785 |
| 432 | 456C1CO1.220 | cgpGmo-S1424a |  | 1 | 0.806 |
| 433 | 456C1CO1.367 | cgpGmo-S1424b | V | 2 | 0.99 |
| 434 | 4594C1CO1.1283 | cgpGmo-S1425 | V | 2 | 0.9 |
| 435 | 4636C2CO1.324 | cgpGmo-S1426 | V | 2 | 0.94 |
| 436 | 4647C1CO1.423 | cgpGmo-S1427 |  | 2 | 0.67 |
| 437 | 4659C1CO1.435 | cgpGmo-S1428 | V | 2 | 0.81 |
| 438 | 1060C1CO1.304 | cgpGmo-S143 | V | 1 | 0.823 |
| 439 | 4697C1CO1.270 | cgpGmo-S1430a | V | 2 | 0.96 |
| 440 | 4697C1CO1.624 | cgpGmo-S1430b | V | 2 | 0.94 |
| 441 | 4699C1CO1.364 | cgpGmo-S1431a | V | 2 | 0.91 |
| 442 | 4699C1CO1.442 | cgpGmo-S1431b |  | 1 | 0.889 |
| 443 | 4699C1CO1.531 | cgpGmo-S1431c |  | 2 | 0.9 |
| 444 | 4712C1CO1.592 | cgpGmo-S1432 | V | 2 | 0.84 |
| 445 | 4748C1CO1.393 | cgpGmo-S1435 | V | 2 | 0.98 |
| 446 | 4802C1CO1.592 | cgpGmo-S1438 | V | 2 | 0.98 |
| 447 | 10641C1CO1.392 | cgpGmo-S144 |  | 1 | 0.665 |
| 448 | 4843C1CO1.114 | cgpGmo-S1441 |  | 2 | 0.91 |
| 449 | 4847C1CO1.268 | cgpGmo-S1442 | V | 2 | 0.96 |
| 450 | 4888C1CO1.932 | cgpGmo-S1445 |  | 2 | 0.96 |
| 451 | 1065C1CO1.551 | cgpGmo-S145 | V | 1 | 0.776 |
| 452 | 4998C1CO1.73 | cgpGmo-S1451 |  | 2 | 0.89 |
| 453 | 503C1CO1.465 | cgpGmo-S1452 |  | 2 | 0.83 |
| 454 | 5089C1CO1.163 | cgpGmo-S1454 | V | 2 | 0.81 |
| 455 | 516C1CO1.428 | cgpGmo-S1455 |  | 2 | 0.92 |
| 456 | 518C1CO1.546 | cgpGmo-S1456 |  | 2 | 0.73 |
| 457 | 5280C1CO1.264 | cgpGmo-S1457 |  | 2 | 0.84 |
| 458 | 5296C1CO1.152 | cgpGmo-S1459a | V | 2 | 0.93 |
| 459 | 5296C1CO1.280 | cgpGmo-S1459b |  | 2 | 0.92 |
| 460 | 106C1CO1.209 | cgpGmo-S146 |  | 1 | 0.898 |
| 461 | 5322C1CO1.227 | cgpGmo-S1461a | V | 2 | 0.93 |
| 462 | 5322C1CO1.297 | cgpGmo-S1461b | V | 2 | 0.92 |
| 463 | 5346C2CO1.215 | cgpGmo-S1463a | V | 1 | 0.722 |
| 464 | 5346C2CO1.499 | cgpGmo-S1463b | V | 2 | 0.93 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 465 | 5373C1CO1.823 | cgpGmo-S1465 | V | 2 | 0.95 |
| 466 | 5375C1CO2.253 | cgpGmo-S1466a | V | 2 | 0.96 |
| 467 | 5375C1CO2.398 | cgpGmo-S1466b | V | 2 | 0.94 |
| 468 | 5375C2CO1.93 | cgpGmo-S1467 | V | 2 | 0.85 |
| 469 | 5421C1CO1.240 | cgpGmo-S1469 | V | 2 | 0.93 |
| 470 | 1073C1CO1.202 | cgpGmo-S147 | V | 1 | 0.851 |
| 471 | 5467C1CO1.160 | cgpGmo-S1470 |   | 2 | 0.78 |
| 472 | 5504C1CO1.387 | cgpGmo-S1471 | V | 2 | 0.93 |
| 473 | 5517C1CO1.337 | cgpGmo-S1473 | V | 2 | 0.69 |
| 474 | 5600C1CO1.268 | cgpGmo-S1474 | V | 2 | 0.93 |
| 475 | 5617C1CO1.103 | cgpGmo-S1475 | V | 2 | 0.97 |
| 476 | 5625C1CO1.558 | cgpGmo-S1476a |   | 2 | 0.99 |
| 477 | 5625C1CO1.630 | cgpGmo-S1476b |   | 2 | 0.98 |
| 478 | 1074C2CO1.571 | cgpGmo-S148 |   | 1 | 0.483 |
| 479 | 568C2CO1.420 | cgpGmo-S1480 |   | 2 | 0.77 |
| 480 | 5737C1CO1.405 | cgpGmo-S1482 | V | 2 | 0.93 |
| 481 | 5743C2CO1.555 | cgpGmo-S1483 | V | 2 | 0.65 |
| 482 | 5747C1CO1.415 | cgpGmo-S1484 | V | 2 | 0.93 |
| 483 | 5827C1CO1.980 | cgpGmo-S1487a |   | 2 | 0.98 |
| 484 | 5827C1CO1.1105 | cgpGmo-S1487b |   | 2 | 0.95 |
| 485 | 5827C1CO1.1331 | cgpGmo-S1487c |   | 2 | 0.96 |
| 486 | 5827C1CO1.1420 | cgpGmo-S1487d |   | 1 | 0.474 |
| 487 | 5854C1CO1.475 | cgpGmo-S1489 | V | 2 | 0.96 |
| 488 | 1077C1CO1.170 | cgpGmo-S149 | V | 1 | 0.7 |
| 489 | 5869C1CO1.1200 | cgpGmo-S1490 |   | 2 | 0.67 |
| 490 | 5905C1CO1.177 | cgpGmo-S1491a |   | 2 | 0.64 |
| 491 | 5905C1CO2.292 | cgpGmo-S1491b | V | 1 | 0.561 |
| 492 | 5905C1CO2.516 | cgpGmo-S1491c | V | 2 | 0.97 |
| 493 | 5913C1CO1.190 | cgpGmo-S1492 |   | 2 | 0.86 |
| 494 | 5927C1CO1.395 | cgpGmo-S1493 |   | 2 | 0.9 |
| 495 | 5940C2CO1.1110 | cgpGmo-S1495 | V | 2 | 0.94 |
| 496 | 5977C2CO1.185 | cgpGmo-S1497 | V | 2 | 0.94 |
| 497 | 10876C1CO1.410 | cgpGmo-S150 | V | 1 | 0.88 |
| 498 | 6017C1CO1.424 | cgpGmo-S1501a |   | 2 | 0.81 |
| 499 | 6017C1CO1.552 | cgpGmo-S1501b |   | 2 | 0.88 |
| 500 | 604C1CO1.333 | cgpGmo-S1503 | V | 2 | 0.94 |
| 501 | 6051C2CO1.253 | cgpGmo-S1504 | V | 2 | 0.92 |
| 502 | 6096C1CO1.150 | cgpGmo-S1505 |   | 2 | 0.76 |
| 503 | 6142C1CO1.242 | cgpGmo-S1506 | V | 2 | 0.96 |
| 504 | 6160C1CO1.86 | cgpGmo-S1507 | V | 2 | 0.75 |
| 505 | 6186C2CO1.571 | cgpGmo-S1509 |   | 2 | 0.63 |
| 506 | 1087C1CO1.259 | cgpGmo-S151 |   | 1 | 0.69 |
| 507 | 6262C1CO1.354 | cgpGmo-S1510 | V | 2 | 0.92 |
| 508 | 6370C1CO1.457 | cgpGmo-S1513 | V | 2 | 0.72 |
| 509 | 6401C1CO1.317 | cgpGmo-S1515 |   | 2 | 0.76 |
| 510 | 6462C2CO1.671 | cgpGmo-S1517 |   | 2 | 0.43 |
| 511 | 6479C1CO1.478 | cgpGmo-S1518a |   | 2 | 0.92 |
| 512 | 6479C1CO1.611 | cgpGmo-S1518b |   | 2 | 0.98 |
| 513 | 6489C1CO1.213 | cgpGmo-S1519 | V | 2 | 0.53 |
| 514 | 1098C1CO1.297 | cgpGmo-S152 | V | 1 | 0.611 |
| 515 | 6495C1CO1.380 | cgpGmo-S1520 | V | 2 | 0.94 |
| 516 | 6499C1CO1.445 | cgpGmo-S1521 |   | 2 | 0.93 |
| 517 | 655C2CO1.489 | cgpGmo-S1522 | V | 2 | 0.87 |
| 518 | 6608C1CO1.243 | cgpGmo-S1523 |   | 2 | 0.92 |
| 519 | 664C3CO1.85 | cgpGmo-S1527 |   | 2 | 0.98 |
| 520 | 6672C1CO1.288 | cgpGmo-S1528a | V | 2 | 0.66 |
| 521 | 6672C1CO1.562 | cgpGmo-S1528b |   | 2 | 0.81 |
| 522 | 6673C1CO1.387 | cgpGmo-S1529 |   | 2 | 0.92 |
| 523 | 6688C1CO1.485 | cgpGmo-S1530 | V | 2 | 0.95 |
| 524 | 6720C1CO1.684 | cgpGmo-S1532 | V | 2 | 0.96 |
| 525 | 6818C2CO1.136 | cgpGmo-S1538a | V | 2 | 0.65 |
| 526 | 6818C2CO1.369 | cgpGmo-S1538b | V | 2 | 0.95 |
| 527 | 10990C1CO1.218 | cgpGmo-S153a | V | 2 | 0.86 |
| 528 | 10990C1CO1.536 | cgpGmo-S153b |   | 1 | 0.785 |
| 529 | 10C1CO1.172 | cgpGmo-S154 | V | 1 | 0.754 |
| 530 | 6821C1CO1.174 | cgpGmo-S1540 |   | 2 | 0.99 |
| 531 | 6849C3CO1.262 | cgpGmo-S1541a | V | 2 | 0.99 |
| 532 | 6849C3CO1.403 | cgpGmo-S1541b | V | 2 | 0.95 |
| 533 | 6864C2CO1.532 | cgpGmo-S1542 |   | 2 | 0.95 |
| 534 | 6903C1CO1.213 | cgpGmo-S1543 | V | 2 | 0.94 |
| 535 | 6925C1CO1.616 | cgpGmo-S1545 |   | 2 | 0.82 |
| 536 | 7086C1CO1.118 | cgpGmo-S1547 |   | 2 | 0.83 |
| 537 | 7091C1CO1.664 | cgpGmo-S1548 | V | 2 | 0.94 |
| 538 | 712C1CO1.182 | cgpGmo-S1549 | V | 2 | 0.92 |
| 539 | 11004C1CO1.105 | cgpGmo-S155 | V | 1 | 0.796 |
| 540 | 7183C1CO1.151 | cgpGmo-S1550 |   | 2 | 0.97 |
| 541 | 7219C1CO1.301 | cgpGmo-S1552a | V | 2 | 0.88 |
| 542 | 7219C1CO1.427 | cgpGmo-S1552b | V | 1 | 0.655 |
| 543 | 724C1CO1.72 | cgpGmo-S1553a | V | 2 | 0.98 |
| 544 | 724C1CO1.555 | cgpGmo-S1553b | V | 2 | 0.85 |
| 545 | 7265C2CO1.448 | cgpGmo-S1555 |   | 2 | 0.61 |
| 546 | 7288C1CO1.182 | cgpGmo-S1556 | V | 2 | 0.66 |
| 547 | 729C1CO1.665 | cgpGmo-S1557 |   | 2 | 0.82 |
| 548 | 730C1CO1.404 | cgpGmo-S1558 | V | 2 | 0.87 |
| 549 | 7378C1CO1.1238 | cgpGmo-S1559 |   | 2 | 0.87 |
| 550 | 11012C1CO1.180 | cgpGmo-S156 | V | 1 | 0.864 |
| 551 | 7440C1CO1.213 | cgpGmo-S1562 |   | 2 | 0.69 |
| 552 | 272C1CO1.398 | cgpGmo-S1563 | V | 2 | 0.98 |
| 553 | 7441C1CO1.215 | cgpGmo-S1563a |   | 2 | 0.98 |
| 554 | 7441C1CO1.352 | cgpGmo-S1563b |   | 2 | 0.91 |
| 555 | 7441C1CO1.485 | cgpGmo-S1563c | V | 1 | 0.63 |
| 556 | 7444C1CO1.472 | cgpGmo-S1564 | V | 2 | 0.82 |
| 557 | 7451C1CO1.180 | cgpGmo-S1565 |   | 2 | 0.99 |
| 558 | 7470C1CO1.89 | cgpGmo-S1568 | V | 2 | 0.92 |
| 559 | 7505C1CO1.318 | cgpGmo-S1569 |   | 2 | 0.93 |
| 560 | 11032C1CO1.105 | cgpGmo-S157 | V | 1 | 0.718 |
| 561 | 7560C1CO1.245 | cgpGmo-S1571 | V | 2 | 0.87 |
| 562 | 7562C1CO1.138 | cgpGmo-S1572 | V | 2 | 0.93 |
| 563 | 757C1CO1.525 | cgpGmo-S1573 | V | 2 | 0.96 |
| 564 | 7607C1CO1.301 | cgpGmo-S1575 |   | 2 | 0.81 |
| 565 | 7617C1CO1.417 | cgpGmo-S1576 |   | 2 | 0.95 |
| 566 | 7620C1CO1.346 | cgpGmo-S1577 | V | 2 | 0.86 |
| 567 | 7679C1CO1.155 | cgpGmo-S1578 |   | 2 | 0.96 |
| 568 | 7695C1CO1.414 | cgpGmo-S1579 | V | 2 | 0.8 |
| 569 | 7806C1CO1.266 | cgpGmo-S1584 |   | 2 | 0.9 |
| 570 | 7810C1CO1.187 | cgpGmo-S1585a |   | 2 | 0.93 |
| 571 | 7810C1CO1.575 | cgpGmo-S1585b |   | 1 | 0.866 |
| 572 | 7861C1CO1.689 | cgpGmo-S1587 | V | 2 | 0.96 |
| 573 | 787C1CO1.313 | cgpGmo-S1588a | V | 2 | 0.96 |
| 574 | 787C1CO1.484 | cgpGmo-S1588b |   | 2 | 0.9 |
| 575 | 1103C1CO1.328 | cgpGmo-S158a | V | 1 | 0.848 |
| 576 | 1103C1CO1.495 | cgpGmo-S158b |   | 2 | 0.98 |
| 577 | 1116C1CO1.602 | cgpGmo-S159 | V | 1 | 0.899 |
| 578 | 8125C1CO1.311 | cgpGmo-S1594 |   | 2 | 0.9 |
| 579 | 8145C1CO1.316 | cgpGmo-S1596a |   | 2 | 0.87 |
| 580 | 8145C1CO1.536 | cgpGmo-S1596b | V | 2 | 0.98 |
| 581 | 8158C1CO1.520 | cgpGmo-S1597 |   | 2 | 0.82 |
| 582 | 8195C2CO1.467 | cgpGmo-S1598a | V | 1 | 0.476 |
| 583 | 8195C2CO1.572 | cgpGmo-S1598b | V | 2 | 0.82 |
| 584 | 827C1CO1.119 | cgpGmo-S1599 |   | 2 | 0.71 |
| 585 | 111C1CO1.417 | cgpGmo-S160 | V | 1 | 0.86 |
| 586 | 8283C2CO1.598 | cgpGmo-S1600 |   | 2 | 0.98 |
| 587 | 8368C1CO1.536 | cgpGmo-S1603 |   | 2 | 0.96 |
| 588 | 8371C1CO1.166 | cgpGmo-S1604a |   | 1 | 0.528 |
| 589 | 8371C1CO1.384 | cgpGmo-S1604b | V | 2 | 0.88 |
| 590 | 8371C1CO1.500 | cgpGmo-S1604c |   | 2 | 0.93 |
| 591 | 8385C1CO1.625 | cgpGmo-S1607 |   | 2 | 0.68 |
| 592 | 846C1CO1.541 | cgpGmo-S1608 |   | 2 | 0.88 |
| 593 | 8513C1CO1.348 | cgpGmo-S1609a | V | 2 | 0.98 |
| 594 | 8513C1CO1.524 | cgpGmo-S1609b | V | 2 | 0.93 |
| 595 | 854C1CO1.465 | cgpGmo-S1610a |   | 1 | 0.649 |
| 596 | 854C1CO1.634 | cgpGmo-S1610b |   | 2 | 0.87 |
| 597 | 8670C1CO1.300 | cgpGmo-S1612 |   | 2 | 0.99 |
| 598 | 880C1CO1.419 | cgpGmo-S1614 |   | 2 | 0.71 |
| 599 | 8828C1CO1.225 | cgpGmo-S1616 |   | 2 | 0.72 |
| 600 | 891C1CO1.639 | cgpGmo-S1617 | V | 2 | 0.95 |
| 601 | 1120C1CO1.377 | cgpGmo-S161a |   | 1 | 0.876 |
| 602 | 1120C1CO1.604 | cgpGmo-S161b |   | 2 | 0.88 |
| 603 | 1128C1CO1.668 | cgpGmo-S162 | V | 1 | 0.867 |
| 604 | 9139C1CO1.437 | cgpGmo-S1620 |   | 2 | 0.99 |
| 605 | 9149C1CO1.200 | cgpGmo-S1621 | V | 2 | 0.98 |
| 606 | 914C1CO1.610 | cgpGmo-S1622 | V | 2 | 0.99 |
| 607 | 9151C1CO1.430 | cgpGmo-S1623 |   | 2 | 0.68 |
| 608 | 924C13CO1.395 | cgpGmo-S1625a |   | 2 | 0.7 |
| 609 | 924C13CO1.559 | cgpGmo-S1625b |   | 2 | 0.91 |
| 610 | 924C13CO1.695 | cgpGmo-S1625c |   | 1 | 0.589 |
| 611 | 939C1CO1.92 | cgpGmo-S1628 |   | 2 | 0.93 |
| 612 | 9401C1CO1.538 | cgpGmo-S1629 | V | 2 | 0.93 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 613 | 1129C1CO1.235 | cgpGmo-S163 | V | 1 | 0.445 |
| 614 | 969C1CO1.243 | cgpGmo-S1634 | V | 2 | 0.94 |
| 615 | 9826C1CO1.566 | cgpGmo-S1637 |   | 2 | 0.66 |
| 616 | 9837C1CO1.266 | cgpGmo-S1638 | V | 2 | 0.95 |
| 617 | 983C1CO1.436 | cgpGmo-S1639 | V | 2 | 0.67 |
| 618 | 1136C1CO1.319 | cgpGmo-S164 |   | 1 | 0.707 |
| 619 | 999C3CO1.354 | cgpGmo-S1641 |   | 2 | 0.55 |
| 620 | 999C5CO1.201 | cgpGmo-S1642 |   | 2 | 0.89 |
| 621 | 0C1CO1.218 | cgpGmo-S1643 | V | 2 | 0.92 |
| 622 | 10005C1CO1.458 | cgpGmo-S1644 | V | 2 | 0.95 |
| 623 | 1005C1CO1.1075 | cgpGmo-S1645 | V | 2 | 0.92 |
| 624 | 10109C2CO1.620 | cgpGmo-S1646 |   | 2 | 0.99 |
| 625 | 1010C2CO1.377 | cgpGmo-S1647 | V | 2 | 0.93 |
| 626 | 10169C1CO1.281 | cgpGmo-S1648 |   | 2 | 0.92 |
| 627 | 1019C1CO1.263 | cgpGmo-S1649 | V | 2 | 0.8 |
| 628 | 11469C1CO1.99 | cgpGmo-S165 |   | 1 | 0.798 |
| 629 | 10218C1CO1.510 | cgpGmo-S1650 | V | 2 | 0.97 |
| 630 | 10265C1CO1.512 | cgpGmo-S1651 | V | 2 | 0.93 |
| 631 | 10363C1CO1.597 | cgpGmo-S1652 | V | 2 | 0.97 |
| 632 | 10377C1CO1.101 | cgpGmo-S1653 | V | 2 | 0.95 |
| 633 | 1044C1CO1.603 | cgpGmo-S1654 | V | 2 | 0.86 |
| 634 | 10481C1CO1.582 | cgpGmo-S1655 | V | 2 | 0.59 |
| 635 | 10487C1CO1.276 | cgpGmo-S1656 | V | 2 | 0.95 |
| 636 | 10509C1CO1.119 | cgpGmo-S1657 | V | 2 | 0.95 |
| 637 | 1053C1CO1.334 | cgpGmo-S1658 | V | 2 | 0.93 |
| 638 | 10568C1CO1.478 | cgpGmo-S1659 | V | 2 | 0.97 |
| 639 | 11488C1CO1.362 | cgpGmo-S166 | V | 1 | 0.723 |
| 640 | 10590C1CO1.513 | cgpGmo-S1660 | V | 2 | 0.94 |
| 641 | 105C1CO1.677 | cgpGmo-S1661 |   | 2 | 0.99 |
| 642 | 10609C1CO1.578 | cgpGmo-S1662 | V | 2 | 0.97 |
| 643 | 1072C1CO1.243 | cgpGmo-S1663 | V | 2 | 0.75 |
| 644 | 1083C1CO1.649 | cgpGmo-S1664 | V | 2 | 0.54 |
| 645 | 10869C1CO1.488 | cgpGmo-S1665 | V | 2 | 0.82 |
| 646 | 11034C1CO1.83 | cgpGmo-S1666 | V | 2 | 0.96 |
| 647 | 1113C1CO1.293 | cgpGmo-S1667 | V | 2 | 0.94 |
| 648 | 1117C1CO1.167 | cgpGmo-S1668 | V | 2 | 0.92 |
| 649 | 11217C1CO1.193 | cgpGmo-S1669 |   | 2 | 0.98 |
| 650 | 1148C1CO1.600 | cgpGmo-S167 | V | 1 | 0.79 |
| 651 | 11305C1CO1.338 | cgpGmo-S1670 | V | 2 | 0.94 |
| 652 | 11382C1CO1.599 | cgpGmo-S1671 |   | 2 | 0.96 |
| 653 | 1152C1CO1.129 | cgpGmo-S1672 | V | 2 | 0.99 |
| 654 | 11916C1CO1.209 | cgpGmo-S1673 | V | 2 | 0.92 |
| 655 | 1201C1CO1.742 | cgpGmo-S1674 | V | 2 | 0.92 |
| 656 | 1211C1CO1.141 | cgpGmo-S1675 | V | 2 | 0.95 |
| 657 | 1247C3CO1.876 | cgpGmo-S1676 |   | 2 | 0.97 |
| 658 | 125C1CO1.584 | cgpGmo-S1677 | V | 2 | 0.92 |
| 659 | 1274C1CO1.245 | cgpGmo-S1678 | V | 2 | 0.97 |
| 660 | 1308C1CO1.110 | cgpGmo-S1679 | V | 2 | 0.65 |
| 661 | 11503C1CO1.495 | cgpGmo-S168 |   | 1 | 0.892 |
| 662 | 1316C1CO1.1402 | cgpGmo-S1680 |   | 2 | 0.93 |
| 663 | 1339C1CO1.304 | cgpGmo-S1681 | V | 2 | 0.98 |
| 664 | 1346C1CO1.209 | cgpGmo-S1682 |   | 2 | 0.94 |
| 665 | 1350C5CO1.168 | cgpGmo-S1683 | V | 2 | 0.97 |
| 666 | 1360C1CO1.269 | cgpGmo-S1684 |   | 2 | 0.98 |
| 667 | 1391C2CO1.215 | cgpGmo-S1685 |   | 2 | 0.71 |
| 668 | 1404C1CO1.66 | cgpGmo-S1686 |   | 2 | 0.97 |
| 669 | 1409C1CO1.1090 | cgpGmo-S1687 |   | 2 | 0.92 |
| 670 | 1410C1CO1.168 | cgpGmo-S1688 |   | 2 | 0.98 |
| 671 | 1414C1CO1.566 | cgpGmo-S1689 | V | 2 | 0.94 |
| 672 | 1415C1CO1.677 | cgpGmo-S1690 |   | 2 | 0.87 |
| 673 | 1426C1CO1.246 | cgpGmo-S1691 | V | 2 | 0.92 |
| 674 | 1434C1CO1.283 | cgpGmo-S1692 |   | 2 | 0.98 |
| 675 | 1453C1CO1.298 | cgpGmo-S1693 | V | 2 | 0.7 |
| 676 | 145C1CO1.261 | cgpGmo-S1694 |   | 2 | 0.92 |
| 677 | 1467C1CO1.440 | cgpGmo-S1695 |   | 2 | 0.99 |
| 678 | 1479C1CO1.257 | cgpGmo-S1696 |   | 2 | 0.94 |
| 679 | 1495C2CO1.341 | cgpGmo-S1697 | V | 2 | 0.95 |
| 680 | 1507C1CO1.82 | cgpGmo-S1698 | V | 2 | 1 |
| 681 | 1512C1CO1.647 | cgpGmo-S1699 |   | 2 | 0.9 |
| 682 | 8106C1CO1.230 | cgpGmo-S16a | V | 2 | 0.93 |
| 683 | 8106C1CO1.666 | cgpGmo-S16b |   | 1 | 0.85 |
| 684 | 1155C1CO1.267 | cgpGmo-S170 | V | 1 | 0.805 |
| 685 | 1524C1CO1.369 | cgpGmo-S1700 | V | 2 | 0.92 |
| 686 | 1536C2CO1.241 | cgpGmo-S1701 | V | 2 | 0.97 |
| 687 | 1540C1CO1.292 | cgpGmo-S1702 | V | 2 | 0.97 |
| 688 | 1591C1CO1.509 | cgpGmo-S1703 | V | 2 | 0.93 |
| 689 | 1597C1CO1.313 | cgpGmo-S1704 | V | 2 | 0.88 |
| 690 | 1612C1CO1.537 | cgpGmo-S1705 | V | 2 | 0.59 |
| 691 | 1625C1CO1.549 | cgpGmo-S1706 | V | 2 | 0.96 |
| 692 | 1630C3CO1.531 | cgpGmo-S1707 | V | 2 | 0.94 |
| 693 | 1637C1CO2.549 | cgpGmo-S1708 | V | 2 | 0.94 |
| 694 | 1652C1CO1.629 | cgpGmo-S1709 |   | 2 | 0.96 |
| 695 | 1161C1CO1.368 | cgpGmo-S171 | V | 1 | 0.841 |
| 696 | 1671C1CO1.340 | cgpGmo-S1710 | V | 2 | 0.96 |
| 697 | 1678C1CO1.81 | cgpGmo-S1711 |   | 2 | 0.97 |
| 698 | 168C1CO1.196 | cgpGmo-S1712 | V | 2 | 0.87 |
| 699 | 170C1CO1.698 | cgpGmo-S1713 | V | 2 | 0.98 |
| 700 | 1733C1CO1.202 | cgpGmo-S1714 | V | 2 | 0.82 |
| 701 | 1739C1CO1.533 | cgpGmo-S1715 | V | 2 | 0.93 |
| 702 | 1754C2CO1.245 | cgpGmo-S1716 | V | 2 | 0.94 |
| 703 | 1771C1CO1.522 | cgpGmo-S1717 |   | 2 | 0.98 |
| 704 | 1775C1CO1.606 | cgpGmo-S1718 | V | 2 | 0.93 |
| 705 | 1799C2CO1.554 | cgpGmo-S1719 |   | 2 | 0.98 |
| 706 | 1161C2CO1.166 | cgpGmo-S172 | V | 1 | 0.511 |
| 707 | 179C1CO1.565 | cgpGmo-S1720 | V | 2 | 0.92 |
| 708 | 17C2CO1.357 | cgpGmo-S1721 | V | 2 | 0.94 |
| 709 | 181C1CO1.65 | cgpGmo-S1722 |   | 2 | 0.99 |
| 710 | 184C1CO1.525 | cgpGmo-S1723 |   | 2 | 0.97 |
| 711 | 1867C2CO1.217 | cgpGmo-S1724 | V | 2 | 0.91 |
| 712 | 1876C1CO1.204 | cgpGmo-S1725 | V | 2 | 0.93 |
| 713 | 187C1CO1.589 | cgpGmo-S1726 |   | 2 | 0.99 |
| 714 | 1926C1CO1.284 | cgpGmo-S1727 | V | 2 | 1 |
| 715 | 1944C2CO1.941 | cgpGmo-S1728 | V | 2 | 0.85 |
| 716 | 1952C1CO1.559 | cgpGmo-S1729 |   | 2 | 0.94 |
| 717 | 1167C1CO1.107 | cgpGmo-S173 | V | 1 | 0.902 |
| 718 | 1959C2CO1.349 | cgpGmo-S1730 | V | 2 | 0.98 |
| 719 | 1965C1CO1.481 | cgpGmo-S1731 | V | 2 | 0.9 |
| 720 | 1966C1CO1.301 | cgpGmo-S1732 |   | 2 | 0.98 |
| 721 | 2011C1CO1.141 | cgpGmo-S1733 | V | 2 | 0.96 |
| 722 | 2022C1CO1.75 | cgpGmo-S1734 |   | 2 | 0.97 |
| 723 | 2025C1CO1.702 | cgpGmo-S1735 |   | 2 | 0.99 |
| 724 | 2052C1CO1.474 | cgpGmo-S1736 | V | 2 | 0.93 |
| 725 | 2075C1CO1.706 | cgpGmo-S1737 | V | 2 | 0.93 |
| 726 | 2089C1CO1.534 | cgpGmo-S1738 | V | 2 | 0.93 |
| 727 | 208C1CO1.333 | cgpGmo-S1739 | V | 2 | 0.94 |
| 728 | 116C1CO1.664 | cgpGmo-S174 | V | 1 | 0.747 |
| 729 | 2095C1CO1.513 | cgpGmo-S1740 |   | 2 | 0.98 |
| 730 | 2118C1CO1.434 | cgpGmo-S1741 | V | 2 | 0.98 |
| 731 | 2131C1CO1.96 | cgpGmo-S1742 | V | 2 | 0.82 |
| 732 | 2134C2CO1.476 | cgpGmo-S1743 | V | 2 | 0.92 |
| 733 | 2150C1CO1.441 | cgpGmo-S1744 | V | 2 | 0.98 |
| 734 | 2158C1CO1.167 | cgpGmo-S1745 | V | 2 | 0.95 |
| 735 | 2165C1CO1.266 | cgpGmo-S1746 |   | 2 | 0.96 |
| 736 | 2166C1CO1.198 | cgpGmo-S1747 | V | 2 | 0.94 |
| 737 | 2168C1CO1.530 | cgpGmo-S1748 | V | 2 | 0.93 |
| 738 | 216C1CO1.473 | cgpGmo-S1749 | V | 2 | 0.94 |
| 739 | 11702C1CO1.644 | cgpGmo-S175 | V | 1 | 0.66 |
| 740 | 2188C2CO1.590 | cgpGmo-S1750 |   | 2 | 0.94 |
| 741 | 2193C1CO1.209 | cgpGmo-S1751 | V | 2 | 0.97 |
| 742 | 2197C1CO1.227 | cgpGmo-S1752 | V | 2 | 0.96 |
| 743 | 2201C2CO1.551 | cgpGmo-S1753 |   | 2 | 0.99 |
| 744 | 2202C1CO1.119 | cgpGmo-S1754 | V | 2 | 0.93 |
| 745 | 2205C1CO1.258 | cgpGmo-S1755 | V | 2 | 0.99 |
| 746 | 2231C1CO1.172 | cgpGmo-S1756 |   | 2 | 0.96 |
| 747 | 2237C1CO1.125 | cgpGmo-S1757 | V | 2 | 0.76 |
| 748 | 2254C17CO1.279 | cgpGmo-S1758 |   | 2 | 0.99 |
| 749 | 2254C18CO1.313 | cgpGmo-S1759 |   | 2 | 0.92 |
| 750 | 1172C1CO1.662 | cgpGmo-S176 |   | 1 | 0.819 |
| 751 | 2263C1CO1.402 | cgpGmo-S1760 | V | 2 | 0.97 |
| 752 | 2269C1CO1.558 | cgpGmo-S1761 | V | 2 | 0.96 |
| 753 | 2277C1CO1.176 | cgpGmo-S1762 | V | 2 | 0.96 |
| 754 | 2295C1CO1.556 | cgpGmo-S1763 | V | 2 | 0.92 |
| 755 | 2306C2CO1.268 | cgpGmo-S1764 | V | 2 | 0.95 |
| 756 | 2318C1CO1.1248 | cgpGmo-S1765 |   | 2 | 0.75 |
| 757 | 232C2CO1.253 | cgpGmo-S1766 |   | 2 | 0.9 |
| 758 | 2361C1CO1.632 | cgpGmo-S1767 | V | 2 | 0.95 |
| 759 | 2387C1CO1.345 | cgpGmo-S1768 | V | 2 | 0.94 |
| 760 | 2399C1CO1.352 | cgpGmo-S1769 | V | 2 | 0.93 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 761 | 2401C2CO1.418 | cgpGmo-S1770 | V | 2 | 0.59 |
| 762 | 2410C1CO1.282 | cgpGmo-S1771 | V | 2 | 0.98 |
| 763 | 2422C1CO1.421 | cgpGmo-S1772 |   | 2 | 0.93 |
| 764 | 2426C1CO1.333 | cgpGmo-S1773 | V | 2 | 0.95 |
| 765 | 2451C1CO1.369 | cgpGmo-S1774 | V | 2 | 0.98 |
| 766 | 2491C1CO1.326 | cgpGmo-S1775 | V | 2 | 0.6 |
| 767 | 2504C1CO1.331 | cgpGmo-S1776 |   | 2 | 0.99 |
| 768 | 2518C2CO1.326 | cgpGmo-S1777 | V | 2 | 0.92 |
| 769 | 2530C2CO1.233 | cgpGmo-S1778 | V | 2 | 0.62 |
| 770 | 2531C3CO1.1174 | cgpGmo-S1779 | V | 2 | 0.92 |
| 771 | 1173C2CO1.290 | cgpGmo-S177a | V | 2 | 0.92 |
| 772 | 1173C2CO1.633 | cgpGmo-S177b |   | 1 | 0.882 |
| 773 | 1178C1CO1.90 | cgpGmo-S178 | V | 1 | 0.848 |
| 774 | 253C1CO1.585 | cgpGmo-S1780 | V | 2 | 0.97 |
| 775 | 2549C1CO1.338 | cgpGmo-S1781 | V | 2 | 0.97 |
| 776 | 2554C1CO1.481 | cgpGmo-S1782 | V | 2 | 0.93 |
| 777 | 2589C1CO1.497 | cgpGmo-S1783 | V | 2 | 0.95 |
| 778 | 2641C1CO1.115 | cgpGmo-S1784 | V | 2 | 0.95 |
| 779 | 2649C1CO1.248 | cgpGmo-S1785 | V | 2 | 0.93 |
| 780 | 2672C1CO1.370 | cgpGmo-S1786 |   | 2 | 0.96 |
| 781 | 2695C1CO1.336 | cgpGmo-S1787 | V | 2 | 0.94 |
| 782 | 2699C2CO1.717 | cgpGmo-S1788 |   | 2 | 0.99 |
| 783 | 2715C1CO1.505 | cgpGmo-S1789 | V | 2 | 0.9 |
| 784 | 2719C1CO1.185 | cgpGmo-S1790 |   | 2 | 0.93 |
| 785 | 2739C1CO1.505 | cgpGmo-S1792 | V | 2 | 0.81 |
| 786 | 2741C1CO1.707 | cgpGmo-S1793 |   | 2 | 0.97 |
| 787 | 2757C1CO1.356 | cgpGmo-S1794 | V | 2 | 0.98 |
| 788 | 2779C1CO1.229 | cgpGmo-S1795 | V | 2 | 0.93 |
| 789 | 277C1CO1.325 | cgpGmo-S1796 |   | 2 | 0.87 |
| 790 | 2788C1CO1.799 | cgpGmo-S1797 | V | 2 | 0.98 |
| 791 | 2792C1CO1.662 | cgpGmo-S1798 | V | 2 | 0.93 |
| 792 | 2796C1CO1.101 | cgpGmo-S1799 | V | 2 | 0.97 |
| 793 | 11900C1CO1.175 | cgpGmo-S179a |   | 2 | 0.96 |
| 794 | 11900C1CO1.303 | cgpGmo-S179b |   | 1 | 0.884 |
| 795 | 372C1CO1.601 | cgpGmo-S17a |   | 2 | 0.71 |
| 796 | 372C1CO1.714 | cgpGmo-S17b |   | 1 | 0.569 |
| 797 | 1916C1CO1.417 | cgpGmo-S18 | V | 1 | 0.74 |
| 798 | 279C1CO1.700 | cgpGmo-S1800 |   | 2 | 0.98 |
| 799 | 2816C1CO1.362 | cgpGmo-S1801 | V | 2 | 0.57 |
| 800 | 2839C1CO1.376 | cgpGmo-S1802 | V | 2 | 0.95 |
| 801 | 284C1CO1.227 | cgpGmo-S1803 | V | 2 | 0.92 |
| 802 | 2859C1CO1.432 | cgpGmo-S1804 | V | 2 | 0.96 |
| 803 | 2884C1CO1.704 | cgpGmo-S1805 | V | 2 | 0.95 |
| 804 | 2899C1CO1.656 | cgpGmo-S1806 | V | 2 | 0.96 |
| 805 | 2914C1CO1.463 | cgpGmo-S1807 | V | 2 | 0.95 |
| 806 | 2916C1CO1.327 | cgpGmo-S1808 | V | 2 | 0.75 |
| 807 | 2917C2CO1.452 | cgpGmo-S1809 | V | 2 | 0.99 |
| 808 | 1215C1CO1.327 | cgpGmo-S180a | V | 2 | 0.91 |
| 809 | 1215C1CO1.596 | cgpGmo-S180b | V | 1 | 0.71 |
| 810 | 1216C1CO1.411 | cgpGmo-S181 |   | 1 | 0.817 |
| 811 | 2936C1CO1.325 | cgpGmo-S1810 | V | 2 | 0.97 |
| 812 | 2948C1CO1.662 | cgpGmo-S1811 |   | 2 | 0.97 |
| 813 | 2954C1CO1.222 | cgpGmo-S1812 |   | 2 | 0.92 |
| 814 | 2957C1CO1.841 | cgpGmo-S1813 | V | 2 | 0.89 |
| 815 | 2965C2CO1.622 | cgpGmo-S1814 | V | 2 | 0.94 |
| 816 | 296C1CO1.398 | cgpGmo-S1815 |   | 2 | 0.94 |
| 817 | 3000C1CO1.525 | cgpGmo-S1816 |   | 2 | 0.93 |
| 818 | 3004C1CO1.111 | cgpGmo-S1817 | V | 2 | 0.98 |
| 819 | 3008C1CO1.223 | cgpGmo-S1818 | V | 2 | 0.96 |
| 820 | 3059C1CO1.1264 | cgpGmo-S1819 |   | 2 | 0.96 |
| 821 | 1223C1CO1.312 | cgpGmo-S182 | V | 1 | 0.541 |
| 822 | 3091C1CO1.392 | cgpGmo-S1820 | V | 2 | 0.92 |
| 823 | 3100C1CO1.92 | cgpGmo-S1821 | V | 2 | 0.98 |
| 824 | 310C1CO1.149 | cgpGmo-S1822 |   | 2 | 0.92 |
| 825 | 3114C1CO1.287 | cgpGmo-S1823 | V | 2 | 0.98 |
| 826 | 3117C1CO1.252 | cgpGmo-S1824 | V | 2 | 0.99 |
| 827 | 3140C1CO1.133 | cgpGmo-S1825 | V | 2 | 0.97 |
| 828 | 3162C1CO1.368 | cgpGmo-S1826 | V | 2 | 0.98 |
| 829 | 3166C2CO1.459 | cgpGmo-S1827 |   | 2 | 0.93 |
| 830 | 3177C1CO1.488 | cgpGmo-S1828 |   | 2 | 0.96 |
| 831 | 318C1CO1.160 | cgpGmo-S1829 |   | 2 | 0.97 |
| 832 | 1224C1CO1.341 | cgpGmo-S183 | V | 1 | 0.839 |
| 833 | 31C1CO1.398 | cgpGmo-S1830 | V | 2 | 0.95 |
| 834 | 3221C1CO1.559 | cgpGmo-S1831 |   | 2 | 0.99 |
| 835 | 322C2CO1.674 | cgpGmo-S1832 | V | 2 | 0.96 |
| 836 | 3237C1CO1.471 | cgpGmo-S1833 | V | 2 | 0.98 |
| 837 | 3247C1CO1.95 | cgpGmo-S1834 | V | 2 | 0.98 |
| 838 | 3254C2CO1.516 | cgpGmo-S1835 | V | 2 | 0.96 |
| 839 | 3281C1CO1.427 | cgpGmo-S1836 | V | 2 | 0.96 |
| 840 | 3283C1CO1.243 | cgpGmo-S1837 | V | 2 | 0.99 |
| 841 | 3298C1CO1.396 | cgpGmo-S1838 |   | 2 | 0.97 |
| 842 | 3300C2CO1.459 | cgpGmo-S1839 | V | 2 | 0.99 |
| 843 | 1225C2CO1.618 | cgpGmo-S184 | V | 1 | 0.891 |
| 844 | 3302C1CO1.524 | cgpGmo-S1840 | V | 2 | 0.81 |
| 845 | 3321C2CO1.408 | cgpGmo-S1841 | V | 2 | 0.96 |
| 846 | 332C1CO1.302 | cgpGmo-S1842 | V | 2 | 0.99 |
| 847 | 3332C1CO1.415 | cgpGmo-S1843 | V | 2 | 0.92 |
| 848 | 3337C4CO1.558 | cgpGmo-S1844 | V | 2 | 0.98 |
| 849 | 3350C1CO1.531 | cgpGmo-S1845 | V | 2 | 0.96 |
| 850 | 3364C1CO1.455 | cgpGmo-S1846 |   | 2 | 0.94 |
| 851 | 336C1CO1.89 | cgpGmo-S1847 | V | 2 | 0.98 |
| 852 | 3375C1CO1.221 | cgpGmo-S1848 |   | 2 | 0.97 |
| 853 | 3381C2CO1.205 | cgpGmo-S1849 |   | 2 | 0.98 |
| 854 | 1229C1CO1.545 | cgpGmo-S185 | V | 1 | 0.841 |
| 855 | 3392C1CO1.288 | cgpGmo-S1850 | V | 2 | 0.98 |
| 856 | 3406C1CO1.454 | cgpGmo-S1851 |   | 2 | 0.98 |
| 857 | 3415C1CO1.401 | cgpGmo-S1852 | V | 2 | 0.88 |
| 858 | 3436C1CO1.182 | cgpGmo-S1853 | V | 2 | 0.95 |
| 859 | 3449C1CO1.691 | cgpGmo-S1854 |   | 2 | 0.97 |
| 860 | 3455C1CO1.171 | cgpGmo-S1855 |   | 2 | 0.99 |
| 861 | 3461C1CO1.307 | cgpGmo-S1856 | V | 2 | 0.94 |
| 862 | 3468C1CO1.447 | cgpGmo-S1857 | V | 2 | 0.95 |
| 863 | 346C1CO1.463 | cgpGmo-S1858 |   | 2 | 0.98 |
| 864 | 3474C1CO1.384 | cgpGmo-S1859 | V | 2 | 0.87 |
| 865 | 1231C2CO1.552 | cgpGmo-S186 |   | 1 | 0.871 |
| 866 | 347C1CO1.552 | cgpGmo-S1860 |   | 2 | 0.96 |
| 867 | 3488C1CO1.138 | cgpGmo-S1861 |   | 2 | 0.95 |
| 868 | 3496C2CO1.222 | cgpGmo-S1862 | V | 2 | 0.91 |
| 869 | 3507C1CO1.479 | cgpGmo-S1863 |   | 2 | 0.92 |
| 870 | 3511C1CO1.570 | cgpGmo-S1864 | V | 2 | 0.98 |
| 871 | 3533C1CO1.216 | cgpGmo-S1865 |   | 2 | 0.95 |
| 872 | 3554C1CO1.108 | cgpGmo-S1866 |   | 2 | 0.59 |
| 873 | 3585C2CO1.295 | cgpGmo-S1867 | V | 2 | 0.98 |
| 874 | 3590C1CO1.517 | cgpGmo-S1868 | V | 2 | 0.94 |
| 875 | 3596C1CO1.655 | cgpGmo-S1869 | V | 2 | 0.96 |
| 876 | 1236C2CO1.382 | cgpGmo-S187 |   | 1 | 0.613 |
| 877 | 3607C1CO1.386 | cgpGmo-S1870 |   | 2 | 0.75 |
| 878 | 3617C1CO1.152 | cgpGmo-S1871 |   | 2 | 0.92 |
| 879 | 362C1CO1.369 | cgpGmo-S1872 | V | 2 | 0.92 |
| 880 | 3636C1CO1.302 | cgpGmo-S1873 |   | 2 | 0.97 |
| 881 | 3647C1CO1.572 | cgpGmo-S1874 | V | 2 | 0.72 |
| 882 | 3649C1CO1.129 | cgpGmo-S1875 |   | 2 | 1 |
| 883 | 3676C1CO1.262 | cgpGmo-S1876 |   | 2 | 0.94 |
| 884 | 3679C1CO1.474 | cgpGmo-S1877 |   | 2 | 1 |
| 885 | 36C9CO1.1008 | cgpGmo-S1878 |   | 2 | 0.93 |
| 886 | 3706C1CO1.417 | cgpGmo-S1879 | V | 2 | 0.92 |
| 887 | 1237C1CO1.1032 | cgpGmo-S188 |   | 1 | 0.6 |
| 888 | 3712C3CO1.570 | cgpGmo-S1880 |   | 2 | 0.92 |
| 889 | 3718C1CO1.677 | cgpGmo-S1881 |   | 2 | 0.92 |
| 890 | 371C3CO1.234 | cgpGmo-S1882 |   | 2 | 0.95 |
| 891 | 3727C1CO1.552 | cgpGmo-S1883 | V | 2 | 0.69 |
| 892 | 3729C1CO1.531 | cgpGmo-S1884 |   | 2 | 0.92 |
| 893 | 3737C1CO1.561 | cgpGmo-S1885 |   | 2 | 0.97 |
| 894 | 3742C1CO1.649 | cgpGmo-S1886 |   | 2 | 0.94 |
| 895 | 3761C2CO1.570 | cgpGmo-S1887 | V | 2 | 0.95 |
| 896 | 3806C1CO1.849 | cgpGmo-S1888 |   | 2 | 0.92 |
| 897 | 3851C1CO1.498 | cgpGmo-S1889 |   | 2 | 0.99 |
| 898 | 1238C2CO1.220 | cgpGmo-S189 | V | 1 | 0.498 |
| 899 | 3867C1CO1.881 | cgpGmo-S1890 |   | 2 | 1 |
| 900 | 3870C1CO1.538 | cgpGmo-S1891 |   | 2 | 0.99 |
| 901 | 3881C1CO1.74 | cgpGmo-S1892 |   | 2 | 0.94 |
| 902 | 3883C1CO1.678 | cgpGmo-S1893 |   | 2 | 0.98 |
| 903 | 3894C1CO1.506 | cgpGmo-S1894 |   | 2 | 0.97 |
| 904 | 3901C1CO1.899 | cgpGmo-S1895 |   | 2 | 1 |
| 905 | 3905C1CO1.885 | cgpGmo-S1896 | V | 2 | 0.97 |
| 906 | 3918C3CO1.370 | cgpGmo-S1897 |   | 2 | 0.96 |
| 907 | 3937C1CO1.511 | cgpGmo-S1898 |   | 2 | 0.93 |
| 908 | 394C2CO1.548 | cgpGmo-S1899 | V | 2 | 0.99 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 909 | 4988C1CO1.610 | cgpGmo-S19 | V | 1 | 0.642 |
| 910 | 1259C1CO1.160 | cgpGmo-S190 | V | 1 | 0.91 |
| 911 | 3978C1CO1.163 | cgpGmo-S1900 | V | 2 | 0.92 |
| 912 | 3980C1CO1.638 | cgpGmo-S1901 |   | 2 | 0.95 |
| 913 | 3983C1CO1.275 | cgpGmo-S1902 | V | 2 | 0.97 |
| 914 | 3987C1CO1.739 | cgpGmo-S1903 | V | 2 | 0.98 |
| 915 | 4008C1CO1.545 | cgpGmo-S1904 | V | 2 | 0.95 |
| 916 | 4016C1CO1.62 | cgpGmo-S1905 | V | 2 | 0.98 |
| 917 | 4041C1CO1.449 | cgpGmo-S1906 | V | 2 | 0.93 |
| 918 | 4044C1CO1.406 | cgpGmo-S1907 | V | 2 | 0.67 |
| 919 | 4049C1CO1.243 | cgpGmo-S1908 | V | 2 | 1 |
| 920 | 4056C1CO1.674 | cgpGmo-S1909 | V | 2 | 0.96 |
| 921 | 1261C1CO1.474 | cgpGmo-S191 | V | 1 | 0.877 |
| 922 | 4068C1CO1.600 | cgpGmo-S1910 | V | 2 | 0.98 |
| 923 | 4075C1CO1.170 | cgpGmo-S1911 |   | 2 | 0.95 |
| 924 | 4082C1CO1.702 | cgpGmo-S1912 |   | 2 | 0.97 |
| 925 | 4114C1CO1.129 | cgpGmo-S1913 | V | 2 | 0.97 |
| 926 | 4115C1CO1.515 | cgpGmo-S1914 | V | 2 | 0.95 |
| 927 | 4119C1CO1.637 | cgpGmo-S1915 |   | 2 | 0.95 |
| 928 | 4138C1CO1.447 | cgpGmo-S1916 | V | 2 | 0.94 |
| 929 | 4139C1CO1.443 | cgpGmo-S1917 | V | 2 | 0.94 |
| 930 | 4141C1CO1.376 | cgpGmo-S1918 |   | 2 | 0.96 |
| 931 | 414C1CO1.432 | cgpGmo-S1919 | V | 2 | 0.99 |
| 932 | 4156C1CO1.400 | cgpGmo-S1920 | V | 2 | 0.96 |
| 933 | 415C2CO1.634 | cgpGmo-S1921 |   | 2 | 0.96 |
| 934 | 4176C1CO1.533 | cgpGmo-S1922 | V | 2 | 0.97 |
| 935 | 4185C1CO1.502 | cgpGmo-S1923 |   | 2 | 0.97 |
| 936 | 4192C1CO1.248 | cgpGmo-S1924 | V | 2 | 0.93 |
| 937 | 4203C1CO1.217 | cgpGmo-S1925 | V | 2 | 0.63 |
| 938 | 420C1CO1.249 | cgpGmo-S1926 | V | 2 | 0.82 |
| 939 | 4211C1CO1.447 | cgpGmo-S1927 | V | 2 | 0.99 |
| 940 | 4239C1CO1.62 | cgpGmo-S1928 | V | 2 | 0.92 |
| 941 | 4242C1CO1.285 | cgpGmo-S1929 | V | 2 | 0.92 |
| 942 | 1266C1CO1.382 | cgpGmo-S192a |   | 1 | 0.734 |
| 943 | 1266C1CO1.559 | cgpGmo-S192b | V | 2 | 0.77 |
| 944 | 126C1CO1.199 | cgpGmo-S193 | V | 1 | 0.873 |
| 945 | 4245C1CO1.390 | cgpGmo-S1930 |   | 2 | 0.96 |
| 946 | 426C1CO1.361 | cgpGmo-S1931 | V | 2 | 0.97 |
| 947 | 4272C1CO1.610 | cgpGmo-S1932 | V | 2 | 0.93 |
| 948 | 4279C1CO1.485 | cgpGmo-S1933 |   | 2 | 1 |
| 949 | 428C2CO1.100 | cgpGmo-S1934 |   | 2 | 0.99 |
| 950 | 429C1CO1.366 | cgpGmo-S1935 | V | 2 | 0.92 |
| 951 | 4315C1CO1.451 | cgpGmo-S1936 | V | 2 | 0.93 |
| 952 | 4358C1CO1.138 | cgpGmo-S1937 | V | 2 | 0.99 |
| 953 | 4360C1CO1.240 | cgpGmo-S1938 | V | 2 | 0.93 |
| 954 | 4380C1CO1.92 | cgpGmo-S1939 |   | 2 | 0.83 |
| 955 | 4381C1CO1.462 | cgpGmo-S1940 |   | 2 | 0.73 |
| 956 | 4382C1CO1.533 | cgpGmo-S1941 | V | 2 | 0.94 |
| 957 | 4390C2CO1.279 | cgpGmo-S1942 | V | 2 | 0.94 |
| 958 | 4416C1CO1.539 | cgpGmo-S1943 | V | 2 | 0.93 |
| 959 | 4417C1CO1.672 | cgpGmo-S1944 | V | 2 | 0.82 |
| 960 | 4427C1CO1.243 | cgpGmo-S1945 | V | 2 | 0.77 |
| 961 | 443C1CO1.429 | cgpGmo-S1946 |   | 2 | 0.96 |
| 962 | 4476C1CO1.672 | cgpGmo-S1947 | V | 2 | 0.92 |
| 963 | 4503C1CO1.307 | cgpGmo-S1948 | V | 2 | 0.88 |
| 964 | 4506C1CO1.249 | cgpGmo-S1949 | V | 2 | 0.98 |
| 965 | 1272C1CO1.263 | cgpGmo-S194a |   | 1 | 0.754 |
| 966 | 1272C1CO1.421 | cgpGmo-S194b |   | 2 | 0.98 |
| 967 | 1273C1CO1.203 | cgpGmo-S195 | V | 1 | 0.82 |
| 968 | 4508C1CO1.421 | cgpGmo-S1950 |   | 2 | 0.95 |
| 969 | 4513C1CO1.397 | cgpGmo-S1951 | V | 2 | 0.94 |
| 970 | 4517C1CO1.551 | cgpGmo-S1952 | V | 2 | 0.93 |
| 971 | 4518C1CO1.201 | cgpGmo-S1953 |   | 2 | 0.82 |
| 972 | 4524C1CO1.341 | cgpGmo-S1954 | V | 2 | 0.99 |
| 973 | 4525C1CO1.195 | cgpGmo-S1955 | V | 2 | 0.92 |
| 974 | 4529C2CO1.276 | cgpGmo-S1956 |   | 2 | 0.92 |
| 975 | 453C1CO1.285 | cgpGmo-S1957 | V | 2 | 0.94 |
| 976 | 4542C1CO1.233 | cgpGmo-S1958 |   | 2 | 0.94 |
| 977 | 4546C1CO1.322 | cgpGmo-S1959 | V | 2 | 0.95 |
| 978 | 1287C1CO1.483 | cgpGmo-S196 | V | 1 | 0.894 |
| 979 | 457C1CO1.164 | cgpGmo-S1960 |   | 2 | 0.87 |
| 980 | 4598C1CO1.135 | cgpGmo-S1961 | V | 2 | 0.96 |
| 981 | 4649C1CO1.962 | cgpGmo-S1962 | V | 2 | 0.97 |
| 982 | 4663C1CO1.477 | cgpGmo-S1963 |   | 2 | 0.99 |
| 983 | 4681C1CO1.1426 | cgpGmo-S1964 |   | 2 | 0.99 |
| 984 | 471C1CO1.410 | cgpGmo-S1965 | V | 2 | 0.95 |
| 985 | 4777C1CO1.396 | cgpGmo-S1966 | V | 2 | 0.93 |
| 986 | 477C1CO1.378 | cgpGmo-S1967 |   | 2 | 0.95 |
| 987 | 4786C1CO1.378 | cgpGmo-S1968 | V | 2 | 0.99 |
| 988 | 4800C1CO1.627 | cgpGmo-S1969 | V | 2 | 0.96 |
| 989 | 482C1CO1.348 | cgpGmo-S1970 | V | 2 | 0.95 |
| 990 | 4831C1CO1.304 | cgpGmo-S1971 |   | 2 | 0.99 |
| 991 | 4839C1CO1.476 | cgpGmo-S1972 | V | 2 | 0.97 |
| 992 | 4842C1CO1.414 | cgpGmo-S1973 |   | 2 | 0.95 |
| 993 | 4853C1CO1.120 | cgpGmo-S1974 | V | 2 | 0.99 |
| 994 | 4860C1CO1.414 | cgpGmo-S1975 |   | 2 | 0.99 |
| 995 | 4862C1CO1.250 | cgpGmo-S1976 |   | 2 | 0.98 |
| 996 | 4863C1CO1.276 | cgpGmo-S1977 | V | 2 | 0.96 |
| 997 | 4879C1CO1.438 | cgpGmo-S1978 | V | 2 | 0.94 |
| 998 | 4887C1CO1.509 | cgpGmo-S1979 | V | 2 | 0.97 |
| 999 | 1288C1CO1.252 | cgpGmo-S197a | V | 2 | 0.67 |
| 1000 | 1288C1CO1.322 | cgpGmo-S197b | V | 1 | 0.67 |
| 1001 | 1295C2CO1.333 | cgpGmo-S198 | V | 1 | 0.704 |
| 1002 | 4890C1CO1.276 | cgpGmo-S1980 |   | 2 | 0.92 |
| 1003 | 4896C1CO1.513 | cgpGmo-S1981 | V | 2 | 0.96 |
| 1004 | 4901C1CO1.320 | cgpGmo-S1982 | V | 2 | 0.98 |
| 1005 | 490C2CO2.634 | cgpGmo-S1983 |   | 2 | 0.96 |
| 1006 | 4927C1CO1.643 | cgpGmo-S1984 | V | 2 | 0.88 |
| 1007 | 4933C1CO1.252 | cgpGmo-S1985 | V | 2 | 0.92 |
| 1008 | 4957C1CO1.395 | cgpGmo-S1986 |   | 2 | 0.99 |
| 1009 | 4971C1CO1.339 | cgpGmo-S1987 |   | 2 | 0.93 |
| 1010 | 5012C1CO1.576 | cgpGmo-S1988 | V | 2 | 0.92 |
| 1011 | 5023C1CO1.317 | cgpGmo-S1989 | V | 2 | 0.53 |
| 1012 | 129C1CO1.231 | cgpGmo-S199 | V | 1 | 0.455 |
| 1013 | 502C1CO1.201 | cgpGmo-S1990 | V | 2 | 0.95 |
| 1014 | 5069C1CO1.199 | cgpGmo-S1991 | V | 2 | 0.95 |
| 1015 | 509C1CO1.113 | cgpGmo-S1992 | V | 2 | 0.96 |
| 1016 | 5104C1CO1.561 | cgpGmo-S1993 | V | 2 | 0.93 |
| 1017 | 510C4CO1.196 | cgpGmo-S1994 | V | 2 | 0.92 |
| 1018 | 5111C1CO1.515 | cgpGmo-S1995 | V | 2 | 0.96 |
| 1019 | 5125C1CO1.509 | cgpGmo-S1996 |   | 2 | 0.98 |
| 1020 | 5133C1CO1.220 | cgpGmo-S1997 | V | 2 | 0.94 |
| 1021 | 5140C1CO1.323 | cgpGmo-S1998 | V | 2 | 0.96 |
| 1022 | 515C1CO1.168 | cgpGmo-S1999 | V | 2 | 0.93 |
| 1023 | 1691C1CO1.196 | cgpGmo-S2 | V | 1 | 0.76 |
| 1024 | 5992C2CO1.479 | cgpGmo-S20 | V | 1 | 0.577 |
| 1025 | 5187C1CO1.229 | cgpGmo-S2000 |   | 2 | 0.85 |
| 1026 | 5193C1CO1.860 | cgpGmo-S2001 | V | 2 | 0.95 |
| 1027 | 5203C1CO1.431 | cgpGmo-S2002 |   | 2 | 0.93 |
| 1028 | 5209C1CO1.196 | cgpGmo-S2003 |   | 2 | 0.95 |
| 1029 | 5227C1CO1.556 | cgpGmo-S2004 |   | 2 | 0.94 |
| 1030 | 5247C1CO1.124 | cgpGmo-S2005 | V | 2 | 0.96 |
| 1031 | 5251C1CO1.339 | cgpGmo-S2006 |   | 2 | 0.97 |
| 1032 | 5269C1CO1.250 | cgpGmo-S2007 |   | 2 | 0.69 |
| 1033 | 5275C1CO1.461 | cgpGmo-S2008 | V | 2 | 0.96 |
| 1034 | 5281C1CO1.614 | cgpGmo-S2009 |   | 2 | 1 |
| 1035 | 1306C2CO1.180 | cgpGmo-S200a |   | 1 | 0.81 |
| 1036 | 1306C2CO1.379 | cgpGmo-S200b |   | 2 | 0.91 |
| 1037 | 1309C2CO1.282 | cgpGmo-S201 | V | 1 | 0.595 |
| 1038 | 5309C1CO1.854 | cgpGmo-S2010 |   | 2 | 0.99 |
| 1039 | 5325C2CO1.319 | cgpGmo-S2011 | V | 2 | 0.54 |
| 1040 | 5337C1CO1.622 | cgpGmo-S2012 |   | 2 | 0.95 |
| 1041 | 5348C1CO1.397 | cgpGmo-S2013 | V | 2 | 0.82 |
| 1042 | 5354C1CO1.536 | cgpGmo-S2014 |   | 2 | 0.97 |
| 1043 | 5364C1CO1.252 | cgpGmo-S2015 |   | 2 | 0.97 |
| 1044 | 5372C1CO1.323 | cgpGmo-S2016 |   | 2 | 0.98 |
| 1045 | 5427C1CO1.364 | cgpGmo-S2017 |   | 2 | 0.91 |
| 1046 | 5444C1CO1.522 | cgpGmo-S2018 | V | 2 | 0.97 |
| 1047 | 5451C2CO1.120 | cgpGmo-S2019 | V | 2 | 0.97 |
| 1048 | 1310C2CO1.430 | cgpGmo-S202 |   | 1 | 0.912 |
| 1049 | 5471C1CO1.330 | cgpGmo-S2020 |   | 2 | 0.74 |
| 1050 | 5498C1CO1.225 | cgpGmo-S2021 | V | 2 | 0.95 |
| 1051 | 5531C1CO1.199 | cgpGmo-S2022 |   | 2 | 0.69 |
| 1052 | 5538C1CO1.603 | cgpGmo-S2023 |   | 2 | 0.97 |
| 1053 | 553C2CO1.735 | cgpGmo-S2024 |   | 2 | 0.97 |
| 1054 | 5566C1CO1.300 | cgpGmo-S2025 | V | 2 | 0.95 |
| 1055 | 557C1CO1.537 | cgpGmo-S2026 |   | 2 | 0.98 |
| 1056 | 558C1CO1.485 | cgpGmo-S2027 | V | 2 | 0.94 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1057 | 5618C1CO1.373 | cgpGmo-S2028 | V | 2 | 0.94 |
| 1058 | 5643C1CO1.151 | cgpGmo-S2029 | V | 2 | 0.99 |
| 1059 | 1317C1CO1.397 | cgpGmo-S203 | V | 1 | 0.626 |
| 1060 | 5646C1CO1.323 | cgpGmo-S2030 |   | 2 | 0.94 |
| 1061 | 5655C1CO1.488 | cgpGmo-S2031 | V | 2 | 0.97 |
| 1062 | 5693C1CO1.230 | cgpGmo-S2032 | V | 2 | 0.98 |
| 1063 | 5722C1CO1.385 | cgpGmo-S2033 |   | 2 | 0.95 |
| 1064 | 5728C1CO1.359 | cgpGmo-S2034 | V | 2 | 0.92 |
| 1065 | 5735C1CO1.103 | cgpGmo-S2035 | V | 2 | 0.96 |
| 1066 | 5751C2CO1.588 | cgpGmo-S2036 |   | 2 | 0.99 |
| 1067 | 576C1CO1.897 | cgpGmo-S2037 | V | 2 | 0.96 |
| 1068 | 5770C1CO1.326 | cgpGmo-S2038 |   | 2 | 0.9 |
| 1069 | 5773C1CO1.627 | cgpGmo-S2039 |   | 2 | 0.82 |
| 1070 | 1324C1CO1.469 | cgpGmo-S204 | V | 1 | 0.722 |
| 1071 | 5781C1CO1.623 | cgpGmo-S2040 |   | 2 | 0.75 |
| 1072 | 5785C1CO1.591 | cgpGmo-S2041 | V | 2 | 0.89 |
| 1073 | 578C7CO1.96 | cgpGmo-S2042 | V | 2 | 0.93 |
| 1074 | 5799C1CO1.78 | cgpGmo-S2043 |   | 2 | 0.93 |
| 1075 | 581C1CO1.143 | cgpGmo-S2044 | V | 2 | 0.92 |
| 1076 | 5873C1CO1.341 | cgpGmo-S2045 |   | 2 | 0.97 |
| 1077 | 5875C1CO1.173 | cgpGmo-S2046 | V | 2 | 0.76 |
| 1078 | 5886C1CO1.527 | cgpGmo-S2047 |   | 2 | 0.97 |
| 1079 | 5892C1CO1.292 | cgpGmo-S2048 | V | 2 | 0.76 |
| 1080 | 5895C1CO1.188 | cgpGmo-S2049 | V | 2 | 0.99 |
| 1081 | 1325C1CO1.381 | cgpGmo-S205 | V | 1 | 0.764 |
| 1082 | 5896C1CO1.552 | cgpGmo-S2050 | V | 2 | 0.99 |
| 1083 | 5920C1CO1.432 | cgpGmo-S2051 |   | 2 | 0.92 |
| 1084 | 5933C1CO1.286 | cgpGmo-S2052 |   | 2 | 0.89 |
| 1085 | 5934C1CO1.667 | cgpGmo-S2053 | V | 2 | 0.75 |
| 1086 | 5941C2CO1.1141 | cgpGmo-S2054 | V | 2 | 0.98 |
| 1087 | 5964C1CO1.273 | cgpGmo-S2055 | V | 2 | 0.9 |
| 1088 | 597C1CO1.667 | cgpGmo-S2056 | V | 2 | 0.95 |
| 1089 | 5987C1CO1.226 | cgpGmo-S2057 |   | 2 | 0.98 |
| 1090 | 6007C1CO1.377 | cgpGmo-S2058 | V | 2 | 0.96 |
| 1091 | 6014C1CO1.360 | cgpGmo-S2059 | V | 2 | 0.95 |
| 1092 | 1328C1CO1.195 | cgpGmo-S206 | V | 1 | 0.861 |
| 1093 | 6040C1CO1.208 | cgpGmo-S2060 |   | 2 | 0.94 |
| 1094 | 6042C1CO1.676 | cgpGmo-S2061 |   | 2 | 0.71 |
| 1095 | 6093C1CO1.385 | cgpGmo-S2062 |   | 2 | 0.94 |
| 1096 | 6113C1CO1.385 | cgpGmo-S2063 | V | 2 | 0.92 |
| 1097 | 6188C2CO1.248 | cgpGmo-S2064 |   | 2 | 0.98 |
| 1098 | 618C1CO1.108 | cgpGmo-S2065 | V | 2 | 0.93 |
| 1099 | 6204C1CO1.260 | cgpGmo-S2066 | V | 2 | 0.98 |
| 1100 | 6215C2CO1.408 | cgpGmo-S2067 | V | 2 | 0.93 |
| 1101 | 6222C1CO1.639 | cgpGmo-S2068 | V | 2 | 0.93 |
| 1102 | 6224C1CO1.445 | cgpGmo-S2069 | V | 2 | 0.96 |
| 1103 | 132C1CO1.1121 | cgpGmo-S207 | V | 1 | 0.755 |
| 1104 | 6267C1CO1.461 | cgpGmo-S2070 | V | 2 | 0.97 |
| 1105 | 6275C1CO1.576 | cgpGmo-S2071 | V | 2 | 0.95 |
| 1106 | 6281C1CO1.393 | cgpGmo-S2072 | V | 2 | 0.92 |
| 1107 | 6289C1CO1.349 | cgpGmo-S2073 | V | 2 | 0.97 |
| 1108 | 6314C1CO1.109 | cgpGmo-S2074 | V | 2 | 0.96 |
| 1109 | 6315C1CO1.486 | cgpGmo-S2075 | V | 2 | 0.96 |
| 1110 | 631C1CO1.294 | cgpGmo-S2076 |   | 2 | 0.93 |
| 1111 | 6330C1CO1.317 | cgpGmo-S2077 | V | 2 | 0.94 |
| 1112 | 6332C1CO1.180 | cgpGmo-S2078 | V | 2 | 0.99 |
| 1113 | 6344C2CO1.292 | cgpGmo-S2079 | V | 2 | 0.94 |
| 1114 | 6357C1CO1.620 | cgpGmo-S2080 | V | 2 | 0.97 |
| 1115 | 635C3CO1.135 | cgpGmo-S2081 |   | 2 | 0.75 |
| 1116 | 6375C2CO1.601 | cgpGmo-S2082 |   | 2 | 0.75 |
| 1117 | 643C1CO1.353 | cgpGmo-S2083 | V | 2 | 0.95 |
| 1118 | 6446C1CO1.446 | cgpGmo-S2084 |   | 2 | 0.97 |
| 1119 | 6467C1CO1.105 | cgpGmo-S2085 | V | 2 | 0.93 |
| 1120 | 64C1CO1.515 | cgpGmo-S2086 |   | 2 | 0.94 |
| 1121 | 652C8CO1.491 | cgpGmo-S2087 | V | 2 | 0.92 |
| 1122 | 6544C1CO1.127 | cgpGmo-S2088 | V | 2 | 0.98 |
| 1123 | 6545C1CO2.558 | cgpGmo-S2089 | V | 2 | 0.97 |
| 1124 | 1345C1CO1.663 | cgpGmo-S209 | V | 1 | 0.639 |
| 1125 | 6547C2CO1.298 | cgpGmo-S2090 | V | 2 | 0.97 |
| 1126 | 6558C1CO1.582 | cgpGmo-S2091 | V | 2 | 0.93 |
| 1127 | 6598C2CO1.475 | cgpGmo-S2092 |   | 2 | 0.97 |
| 1128 | 6599C1CO1.463 | cgpGmo-S2093 | V | 2 | 0.98 |
| 1129 | 6600C1CO1.1338 | cgpGmo-S2094 | V | 2 | 0.92 |
| 1130 | 6658C1CO1.252 | cgpGmo-S2095 | V | 2 | 0.76 |
| 1131 | 665C3CO1.351 | cgpGmo-S2096 |   | 2 | 0.83 |
| 1132 | 6675C1CO1.512 | cgpGmo-S2097 | V | 2 | 0.95 |
| 1133 | 6704C1CO1.367 | cgpGmo-S2098 | V | 2 | 0.97 |
| 1134 | 6746C2CO1.793 | cgpGmo-S2099 | V | 2 | 0.93 |
| 1135 | 6523C1CO1.223 | cgpGmo-S21 |   | 1 | 0.641 |
| 1136 | 1347C2CO1.580 | cgpGmo-S210 | V | 1 | 0.831 |
| 1137 | 6754C1CO1.440 | cgpGmo-S2100 | V | 2 | 1 |
| 1138 | 6795C1CO1.507 | cgpGmo-S2101 | V | 2 | 0.93 |
| 1139 | 679C1CO1.356 | cgpGmo-S2102 | V | 2 | 0.84 |
| 1140 | 6808C1CO1.468 | cgpGmo-S2103 |   | 2 | 0.99 |
| 1141 | 6810C2CO1.586 | cgpGmo-S2104 | V | 2 | 0.97 |
| 1142 | 6811C1CO1.170 | cgpGmo-S2105 | V | 2 | 0.94 |
| 1143 | 6812C1CO1.509 | cgpGmo-S2106 | V | 2 | 1 |
| 1144 | 6828C1CO1.1167 | cgpGmo-S2107 |   | 2 | 0.95 |
| 1145 | 6857C1CO1.79 | cgpGmo-S2108 | V | 2 | 0.97 |
| 1146 | 687C2CO1.560 | cgpGmo-S2109 |   | 2 | 0.97 |
| 1147 | 135C1CO1.519 | cgpGmo-S211 | V | 1 | 0.652 |
| 1148 | 691C1CO1.671 | cgpGmo-S2110 |   | 2 | 0.96 |
| 1149 | 6926C1CO1.485 | cgpGmo-S2111 | V | 2 | 0.99 |
| 1150 | 694C1CO1.395 | cgpGmo-S2112 | V | 2 | 0.99 |
| 1151 | 6950C1CO1.291 | cgpGmo-S2113 |   | 2 | 0.95 |
| 1152 | 7049C1CO1.146 | cgpGmo-S2114 |   | 2 | 0.95 |
| 1153 | 7051C1CO1.285 | cgpGmo-S2115 | V | 2 | 0.97 |
| 1154 | 7055C1CO1.503 | cgpGmo-S2116 |   | 2 | 0.97 |
| 1155 | 705C1CO1.407 | cgpGmo-S2117 |   | 2 | 0.98 |
| 1156 | 70C1CO1.445 | cgpGmo-S2118 | V | 2 | 0.59 |
| 1157 | 7104C1CO1.130 | cgpGmo-S2119 | V | 2 | 0.98 |
| 1158 | 1377C1CO1.291 | cgpGmo-S212 | V | 1 | 0.807 |
| 1159 | 7129C1CO1.239 | cgpGmo-S2120 |   | 2 | 0.85 |
| 1160 | 714C1CO1.458 | cgpGmo-S2121 |   | 2 | 0.9 |
| 1161 | 7168C1CO1.214 | cgpGmo-S2122 |   | 2 | 0.93 |
| 1162 | 7178C1CO1.556 | cgpGmo-S2123 | V | 2 | 0.99 |
| 1163 | 7182C1CO1.531 | cgpGmo-S2124 |   | 2 | 0.94 |
| 1164 | 7188C1CO1.509 | cgpGmo-S2125 |   | 2 | 0.95 |
| 1165 | 71C1CO1.1376 | cgpGmo-S2126 | V | 2 | 0.97 |
| 1166 | 7224C1CO1.451 | cgpGmo-S2127 |   | 2 | 0.95 |
| 1167 | 7233C1CO1.882 | cgpGmo-S2128 |   | 2 | 0.98 |
| 1168 | 7331C1CO1.733 | cgpGmo-S2129 |   | 2 | 0.92 |
| 1169 | 1378C1CO1.487 | cgpGmo-S213 | V | 1 | 0.86 |
| 1170 | 7333C1CO1.612 | cgpGmo-S2130 | V | 2 | 0.92 |
| 1171 | 7338C1CO1.690 | cgpGmo-S2131 | V | 2 | 0.94 |
| 1172 | 7341C1CO1.253 | cgpGmo-S2132 | V | 2 | 0.93 |
| 1173 | 7410C1CO1.215 | cgpGmo-S2133 |   | 2 | 0.96 |
| 1174 | 7414C1CO1.170 | cgpGmo-S2134 | V | 2 | 0.94 |
| 1175 | 7416C2CO1.108 | cgpGmo-S2135 |   | 2 | 0.98 |
| 1176 | 7421C1CO1.345 | cgpGmo-S2136 |   | 2 | 0.98 |
| 1177 | 7443C1CO1.127 | cgpGmo-S2137 | V | 2 | 0.92 |
| 1178 | 7465C1CO1.496 | cgpGmo-S2138 | V | 2 | 0.93 |
| 1179 | 7467C1CO1.388 | cgpGmo-S2139 | V | 2 | 0.95 |
| 1180 | 1384C2CO2.257 | cgpGmo-S214 |   | 1 | 0.914 |
| 1181 | 7468C1CO1.284 | cgpGmo-S2140 | V | 2 | 0.89 |
| 1182 | 7484C1CO1.527 | cgpGmo-S2141 |   | 2 | 0.92 |
| 1183 | 7488C1CO1.331 | cgpGmo-S2142 | V | 2 | 0.65 |
| 1184 | 7507C1CO1.601 | cgpGmo-S2143 |   | 2 | 0.98 |
| 1185 | 7522C1CO1.150 | cgpGmo-S2144 | V | 2 | 0.93 |
| 1186 | 7565C1CO1.470 | cgpGmo-S2145 | V | 2 | 0.41 |
| 1187 | 7590C1CO1.381 | cgpGmo-S2146 | V | 2 | 0.94 |
| 1188 | 7671C1CO1.220 | cgpGmo-S2147 |   | 2 | 0.92 |
| 1189 | 7704C1CO1.327 | cgpGmo-S2148 | V | 2 | 0.65 |
| 1190 | 7733C1CO1.585 | cgpGmo-S2149 |   | 2 | 0.98 |
| 1191 | 1406C1CO1.183 | cgpGmo-S215 | V | 1 | 0.897 |
| 1192 | 7738C1CO1.109 | cgpGmo-S2150 |   | 2 | 0.98 |
| 1193 | 773C1CO1.467 | cgpGmo-S2151 |   | 2 | 0.92 |
| 1194 | 7796C1CO1.133 | cgpGmo-S2152 |   | 2 | 0.95 |
| 1195 | 7803C1CO1.283 | cgpGmo-S2153 | V | 2 | 0.99 |
| 1196 | 7819C1CO1.388 | cgpGmo-S2154 | V | 2 | 0.97 |
| 1197 | 7828C1CO1.123 | cgpGmo-S2155 | V | 2 | 0.99 |
| 1198 | 7828C2CO1.226 | cgpGmo-S2156 |   | 2 | 0.94 |
| 1199 | 7841C1CO1.404 | cgpGmo-S2157 | V | 2 | 0.93 |
| 1200 | 7875C2CO1.405 | cgpGmo-S2158 | V | 2 | 0.92 |
| 1201 | 789C1CO1.334 | cgpGmo-S2159 |   | 2 | 0.85 |
| 1202 | 1417C2CO1.292 | cgpGmo-S216 | V | 1 | 0.765 |
| 1203 | 7916C1CO1.445 | cgpGmo-S2160 | V | 2 | 0.98 |
| 1204 | 797C2CO1.586 | cgpGmo-S2161 | V | 2 | 0.93 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1205 | 798C1CO2.515 | cgpGmo-S2162 | V | 2 | 0.95 |
| 1206 | 7996C1CO1.453 | cgpGmo-S2163 |   | 2 | 0.97 |
| 1207 | 8020C1CO1.453 | cgpGmo-S2164 | V | 2 | 0.97 |
| 1208 | 8049C1CO1.91 | cgpGmo-S2165 | V | 2 | 0.98 |
| 1209 | 8057C1CO1.606 | cgpGmo-S2166 | V | 2 | 0.96 |
| 1210 | 805C2CO1.110 | cgpGmo-S2167 |   | 2 | 0.95 |
| 1211 | 8086C1CO1.241 | cgpGmo-S2168 |   | 2 | 0.98 |
| 1212 | 8171C1CO1.607 | cgpGmo-S2169 | V | 2 | 0.68 |
| 1213 | 8209C1CO1.528 | cgpGmo-S2170 |   | 2 | 0.99 |
| 1214 | 8273C1CO1.123 | cgpGmo-S2171 | V | 2 | 0.97 |
| 1215 | 8308C1CO1.595 | cgpGmo-S2172 | V | 2 | 0.92 |
| 1216 | 8313C1CO1.586 | cgpGmo-S2173 | V | 2 | 0.83 |
| 1217 | 835C1CO1.283 | cgpGmo-S2174 | V | 2 | 0.98 |
| 1218 | 8414C1CO1.491 | cgpGmo-S2175 | V | 2 | 0.94 |
| 1219 | 8432C1CO1.615 | cgpGmo-S2176 | V | 2 | 0.95 |
| 1220 | 8476C1CO1.67 | cgpGmo-S2177 | V | 2 | 0.95 |
| 1221 | 8563C1CO1.434 | cgpGmo-S2178 | V | 2 | 0.57 |
| 1222 | 8596C1CO1.466 | cgpGmo-S2179 | V | 2 | 0.94 |
| 1223 | 1428C2CO1.182 | cgpGmo-S217a | V | 2 | 0.99 |
| 1224 | 1428C2CO1.386 | cgpGmo-S217b |   | 1 | 0.758 |
| 1225 | 1432C2CO1.416 | cgpGmo-S218 | V | 1 | 0.893 |
| 1226 | 8602C1CO1.579 | cgpGmo-S2180 | V | 2 | 0.96 |
| 1227 | 8631C1CO1.626 | cgpGmo-S2181 |   | 2 | 0.94 |
| 1228 | 865C1CO1.461 | cgpGmo-S2182 | V | 2 | 0.97 |
| 1229 | 8672C1CO1.556 | cgpGmo-S2183 | V | 2 | 0.96 |
| 1230 | 8682C1CO1.523 | cgpGmo-S2184 | V | 2 | 0.93 |
| 1231 | 8701C1CO1.529 | cgpGmo-S2185 | V | 2 | 0.94 |
| 1232 | 8702C1CO1.249 | cgpGmo-S2186 | V | 2 | 0.97 |
| 1233 | 871C1CO1.526 | cgpGmo-S2187 | V | 2 | 0.95 |
| 1234 | 8758C1CO1.314 | cgpGmo-S2188 |   | 2 | 0.83 |
| 1235 | 876C1CO1.776 | cgpGmo-S2189 | V | 2 | 0.94 |
| 1236 | 1444C2CO1.320 | cgpGmo-S219 |   | 1 | 0.897 |
| 1237 | 8873C1CO1.564 | cgpGmo-S2190 |   | 2 | 0.68 |
| 1238 | 892C2CO1.725 | cgpGmo-S2191 | V | 2 | 0.97 |
| 1239 | 8985C1CO1.393 | cgpGmo-S2192 |   | 2 | 0.95 |
| 1240 | 9036C1CO1.107 | cgpGmo-S2193 | V | 2 | 0.96 |
| 1241 | 9062C1CO1.638 | cgpGmo-S2194 |   | 2 | 0.93 |
| 1242 | 9065C1CO1.607 | cgpGmo-S2195 |   | 2 | 0.95 |
| 1243 | 908C1CO1.144 | cgpGmo-S2196 | V | 2 | 0.97 |
| 1244 | 9119C1CO1.819 | cgpGmo-S2197 |   | 2 | 0.93 |
| 1245 | 9128C1CO1.196 | cgpGmo-S2198 | V | 2 | 0.93 |
| 1246 | 9176C1CO1.128 | cgpGmo-S2199 | V | 2 | 0.9 |
| 1247 | 1469C2CO1.175 | cgpGmo-S220 | V | 1 | 0.868 |
| 1248 | 91C1CO1.105 | cgpGmo-S2200 | V | 2 | 1 |
| 1249 | 9212C1CO1.604 | cgpGmo-S2201 | V | 2 | 0.89 |
| 1250 | 9222C1CO1.512 | cgpGmo-S2202 | V | 2 | 0.97 |
| 1251 | 925C1CO1.592 | cgpGmo-S2203 |   | 2 | 0.99 |
| 1252 | 92C3CO1.78 | cgpGmo-S2204 |   | 2 | 0.92 |
| 1253 | 9312C1CO1.390 | cgpGmo-S2205 | V | 2 | 0.94 |
| 1254 | 9359C1CO1.210 | cgpGmo-S2206 |   | 2 | 0.96 |
| 1255 | 9376C1CO1.103 | cgpGmo-S2207 | V | 2 | 0.71 |
| 1256 | 9456C1CO1.448 | cgpGmo-S2208 | V | 2 | 0.58 |
| 1257 | 9481C1CO1.506 | cgpGmo-S2209 |   | 2 | 0.98 |
| 1258 | 9482C1CO1.221 | cgpGmo-S2210 |   | 2 | 0.84 |
| 1259 | 9493C1CO1.74 | cgpGmo-S2211 | V | 2 | 0.93 |
| 1260 | 9550C1CO1.233 | cgpGmo-S2212 | V | 2 | 0.96 |
| 1261 | 955C2CO1.742 | cgpGmo-S2213 |   | 2 | 0.97 |
| 1262 | 9627C1CO1.195 | cgpGmo-S2214 |   | 2 | 0.99 |
| 1263 | 964C2CO1.354 | cgpGmo-S2215 | V | 2 | 0.98 |
| 1264 | 9669C1CO1.339 | cgpGmo-S2216 | V | 2 | 0.94 |
| 1265 | 96C1CO1.251 | cgpGmo-S2217 | V | 2 | 0.66 |
| 1266 | 970C1CO1.355 | cgpGmo-S2218 |   | 2 | 0.92 |
| 1267 | 9737C1CO1.325 | cgpGmo-S2219 | V | 2 | 0.95 |
| 1268 | 1470C1CO1.120 | cgpGmo-S221a | V | 1 | 0.664 |
| 1269 | 1470C1CO1.565 | cgpGmo-S221b |   | 2 | 0.96 |
| 1270 | 1472C1CO1.417 | cgpGmo-S222 |   | 1 | 0.753 |
| 1271 | 9768C1CO1.270 | cgpGmo-S2220 | V | 2 | 0.79 |
| 1272 | 9810C1CO1.661 | cgpGmo-S2221 | V | 2 | 0.99 |
| 1273 | 9902C1CO1.599 | cgpGmo-S2222 |   | 2 | 0.95 |
| 1274 | 9917C1CO1.442 | cgpGmo-S2223 |   | 2 | 0.98 |
| 1275 | 991C1CO1.245 | cgpGmo-S2224 | V | 2 | 0.94 |
| 1276 | 6866C1CO1.522 | cgpGmo-S2225 |   | 1 | 0.551 |
| 1277 | 2016C2CO1.583 | cgpGmo-S2227 |   | 1 | 0.847 |
| 1278 | 374C3CO1.279 | cgpGmo-S2228 |   | 1 | 0.913 |
| 1279 | 4309C1CO1.573 | cgpGmo-S2229 | V | 1 | 0.622 |
| 1280 | 1489C2CO1.404 | cgpGmo-S223 | V | 1 | 0.888 |
| 1281 | 520C1CO1.693 | cgpGmo-S2230 |   | 1 | 0.429 |
| 1282 | 676C1CO1.577 | cgpGmo-S2231 |   | 1 | 0.64 |
| 1283 | 805C1CO1.323 | cgpGmo-S2232 |   | 1 | 0.528 |
| 1284 | 1031C1CO1.106 | cgpGmo-S2234 |   | 1 | 0.724 |
| 1285 | 1332C1CO1.754 | cgpGmo-S2235 | V | 1 | 0.638 |
| 1286 | 1556C1CO1.215 | cgpGmo-S2236 |   | 1 | 0.614 |
| 1287 | 1872C3CO1.115 | cgpGmo-S2238 |   | 1 | 0.542 |
| 1288 | 2112C1CO1.685 | cgpGmo-S2239 | V | 1 | 0.865 |
| 1289 | 1499C1CO1.634 | cgpGmo-S224 | V | 1 | 0.769 |
| 1290 | 2225C1CO1.256 | cgpGmo-S2240 |   | 1 | 0.821 |
| 1291 | 3360C1CO1.575 | cgpGmo-S2242 | V | 1 | 0.806 |
| 1292 | 4143C2CO1.407 | cgpGmo-S2244 |   | 1 | 0.617 |
| 1293 | 5344C1CO1.582 | cgpGmo-S2247 |   | 1 | 0.598 |
| 1294 | 6649C2CO1.422 | cgpGmo-S2249 |   | 1 | 0.89 |
| 1295 | 1137C1CO1.79 | cgpGmo-S2254 | V | 1 | 0.837 |
| 1296 | 115C1CO1.558 | cgpGmo-S2255 | V | 1 | 0.783 |
| 1297 | 1222C1CO1.325 | cgpGmo-S2256 | V | 1 | 0.53 |
| 1298 | 1445C1CO1.228 | cgpGmo-S2257 |   | 1 | 0.902 |
| 1299 | 1554C1CO1.295 | cgpGmo-S2258 |   | 1 | 0.898 |
| 1300 | 1686C1CO1.79 | cgpGmo-S2259 | V | 1 | 0.749 |
| 1301 | 1501C1CO1.105 | cgpGmo-S225a |   | 1 | 0.826 |
| 1302 | 1501C1CO1.189 | cgpGmo-S225b | V | 2 | 0.96 |
| 1303 | 1504C1CO1.358 | cgpGmo-S226 | V | 1 | 0.54 |
| 1304 | 1697C1CO1.128 | cgpGmo-S2260 |   | 1 | 0.895 |
| 1305 | 1747C1CO1.551 | cgpGmo-S2261 |   | 1 | 0.424 |
| 1306 | 1821C1CO1.434 | cgpGmo-S2262 | V | 1 | 0.824 |
| 1307 | 1875C1CO1.211 | cgpGmo-S2263 |   | 1 | 0.561 |
| 1308 | 1913C1CO1.315 | cgpGmo-S2264 | V | 1 | 0.807 |
| 1309 | 2346C1CO1.128 | cgpGmo-S2265 |   | 1 | 0.578 |
| 1310 | 2456C1CO1.115 | cgpGmo-S2266 | V | 1 | 0.887 |
| 1311 | 273C1CO1.366 | cgpGmo-S2267 |   | 1 | 0.812 |
| 1312 | 2838C2CO1.276 | cgpGmo-S2268 |   | 1 | 0.886 |
| 1313 | 2877C1CO1.254 | cgpGmo-S2269 | V | 1 | 0.861 |
| 1314 | 1519C3CO1.144 | cgpGmo-S227 | V | 1 | 0.785 |
| 1315 | 3015C2CO1.529 | cgpGmo-S2270 |   | 1 | 0.834 |
| 1316 | 3098C1CO1.241 | cgpGmo-S2271 |   | 1 | 0.671 |
| 1317 | 3412C1CO1.431 | cgpGmo-S2272 |   | 1 | 0.853 |
| 1318 | 360C1CO1.520 | cgpGmo-S2273 |   | 1 | 0.768 |
| 1319 | 3858C1CO1.259 | cgpGmo-S2274 |   | 1 | 0.841 |
| 1320 | 4030C1CO1.338 | cgpGmo-S2275 |   | 1 | 0.664 |
| 1321 | 4186C1CO1.425 | cgpGmo-S2276 |   | 1 | 0.779 |
| 1322 | 4213C1CO1.163 | cgpGmo-S2277 | V | 1 | 0.823 |
| 1323 | 4486C1CO1.473 | cgpGmo-S2278 |   | 1 | 0.853 |
| 1324 | 5279C1CO1.392 | cgpGmo-S2279 | V | 1 | 0.832 |
| 1325 | 1523C1CO1.166 | cgpGmo-S228 | V | 1 | 0.713 |
| 1326 | 536C1CO1.663 | cgpGmo-S2280 |   | 1 | 0.837 |
| 1327 | 5708C1CO1.378 | cgpGmo-S2281 | V | 1 | 0.719 |
| 1328 | 6269C1CO1.137 | cgpGmo-S2282 |   | 1 | 0.636 |
| 1329 | 6427C1CO1.158 | cgpGmo-S2283 | V | 1 | 0.786 |
| 1330 | 664C2CO1.431 | cgpGmo-S2284 |   | 1 | 0.779 |
| 1331 | 7459C1CO1.298 | cgpGmo-S2285 | V | 1 | 0.658 |
| 1332 | 8512C1CO1.228 | cgpGmo-S2286 | V | 1 | 0.612 |
| 1333 | 926C1CO1.133 | cgpGmo-S2287 | V | 1 | 0.902 |
| 1334 | 967C1CO1.81 | cgpGmo-S2288 | V | 2 | 0.88 |
| 1335 | 1525C1CO1.126 | cgpGmo-S229 | V | 1 | 0.717 |
| 1336 | 11545C1CO1.529 | cgpGmo-S22a |   | 1 | 0.663 |
| 1337 | 11545C1CO1.595 | cgpGmo-S22b | V | 2 | 0.83 |
| 1338 | 1592C1CO1.432 | cgpGmo-S23 | V | 1 | 0.77 |
| 1339 | 152C1CO1.368 | cgpGmo-S230 |   | 1 | 0.543 |
| 1340 | 1533C1CO1.128 | cgpGmo-S231 |   | 1 | 0.831 |
| 1341 | 1534C1CO1.355 | cgpGmo-S232a | V | 1 | 0.455 |
| 1342 | 1534C1CO1.626 | cgpGmo-S232b | V | 2 | 0.89 |
| 1343 | 153C1CO1.459 | cgpGmo-S233 | V | 1 | 0.766 |
| 1344 | 1553C1CO1.428 | cgpGmo-S234 | V | 1 | 0.822 |
| 1345 | 1560C1CO1.117 | cgpGmo-S237a | V | 2 | 0.93 |
| 1346 | 1560C1CO1.217 | cgpGmo-S237b |   | 1 | 0.673 |
| 1347 | 156C2CO1.270 | cgpGmo-S238 |   | 1 | 0.825 |
| 1348 | 1576C2CO1.75 | cgpGmo-S239a | V | 1 | 0.622 |
| 1349 | 1576C2CO1.425 | cgpGmo-S239b | V | 2 | 0.86 |
| 1350 | 1579C1CO1.472 | cgpGmo-S240 | V | 1 | 0.908 |
| 1351 | 1582C1CO1.183 | cgpGmo-S241 | V | 1 | 0.913 |
| 1352 | 1585C1CO1.325 | cgpGmo-S242 | V | 1 | 0.649 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1353 | 1590C1CO1.605 | cgpGmo-S244 | V | 1 | 0.729 |
| 1354 | 1596C2CO1.327 | cgpGmo-S245a | V | 1 | 0.881 |
| 1355 | 1596C2CO1.428 | cgpGmo-S245b | V | 2 | 0.93 |
| 1356 | 1599C11CO1.713 | cgpGmo-S246 | | 1 | 0.895 |
| 1357 | 1599C23CO1.156 | cgpGmo-S247 | V | 1 | 0.68 |
| 1358 | 1605C1CO1.535 | cgpGmo-S248a | V | 2 | 0.95 |
| 1359 | 1605C1CO1.907 | cgpGmo-S248b | | 1 | 0.82 |
| 1360 | 1609C2CO1.678 | cgpGmo-S249 | V | 1 | 0.836 |
| 1361 | 2053C1CO1.439 | cgpGmo-S24a | | 1 | 0.755 |
| 1362 | 2053C1CO1.533 | cgpGmo-S24b | V | 2 | 0.88 |
| 1363 | 21C1CO1.359 | cgpGmo-S25 | V | 1 | 0.478 |
| 1364 | 160C1CO1.474 | cgpGmo-S250 | V | 1 | 0.801 |
| 1365 | 1616C1CO2.570 | cgpGmo-S251 | V | 1 | 0.768 |
| 1366 | 1619C1CO1.174 | cgpGmo-S252 | V | 1 | 0.479 |
| 1367 | 1622C1CO1.390 | cgpGmo-S253 | | 1 | 0.718 |
| 1368 | 1628C1CO1.246 | cgpGmo-S254 | V | 1 | 0.495 |
| 1369 | 1636C1CO1.239 | cgpGmo-S255 | V | 1 | 0.873 |
| 1370 | 164C1CO1.1157 | cgpGmo-S256 | V | 1 | 0.796 |
| 1371 | 1653C3CO1.734 | cgpGmo-S257 | | 1 | 0.908 |
| 1372 | 1656C1CO1.775 | cgpGmo-S258 | V | 1 | 0.912 |
| 1373 | 1665C1CO1.118 | cgpGmo-S259 | V | 1 | 0.552 |
| 1374 | 3935C1CO1.607 | cgpGmo-S26 | V | 1 | 0.668 |
| 1375 | 1673C1CO1.714 | cgpGmo-S260a | V | 2 | 0.96 |
| 1376 | 1673C1CO1.999 | cgpGmo-S260b | V | 1 | 0.856 |
| 1377 | 1673C2CO1.405 | cgpGmo-S261a | | 1 | 0.722 |
| 1378 | 1673C2CO1.615 | cgpGmo-S261b | V | 2 | 0.87 |
| 1379 | 1675C1CO1.371 | cgpGmo-S262a | | 2 | 0.83 |
| 1380 | 1675C1CO1.542 | cgpGmo-S262b | | 1 | 0.656 |
| 1381 | 167C1CO1.210 | cgpGmo-S263 | V | 1 | 0.894 |
| 1382 | 1680C1CO1.113 | cgpGmo-S264 | V | 1 | 0.861 |
| 1383 | 1693C1CO1.284 | cgpGmo-S265 | | 1 | 0.7 |
| 1384 | 1696C1CO1.436 | cgpGmo-S266 | V | 1 | 0.854 |
| 1385 | 1701C1CO1.117 | cgpGmo-S267 | V | 1 | 0.817 |
| 1386 | 1702C2CO1.1095 | cgpGmo-S268 | V | 1 | 0.809 |
| 1387 | 1704C1CO1.949 | cgpGmo-S269 | | 1 | 0.898 |
| 1388 | 1712C1CO1.270 | cgpGmo-S270 | V | 1 | 0.635 |
| 1389 | 1725C1CO1.294 | cgpGmo-S271 | V | 1 | 0.78 |
| 1390 | 1726C1CO1.472 | cgpGmo-S272 | V | 1 | 0.871 |
| 1391 | 1727C1CO1.403 | cgpGmo-S273 | | 1 | 0.908 |
| 1392 | 1738C1CO1.518 | cgpGmo-S274 | | 1 | 0.832 |
| 1393 | 1742C1CO1.369 | cgpGmo-S275 | V | 1 | 0.775 |
| 1394 | 1751C1CO1.270 | cgpGmo-S276a | | 1 | 0.724 |
| 1395 | 1751C1CO1.506 | cgpGmo-S276b | V | 2 | 0.96 |
| 1396 | 1752C1CO1.651 | cgpGmo-S277 | V | 1 | 0.857 |
| 1397 | 1754C1CO1.217 | cgpGmo-S278 | | 1 | 0.76 |
| 1398 | 1766C2CO1.495 | cgpGmo-S279 | | 1 | 0.518 |
| 1399 | 58C14CO1.502 | cgpGmo-S28 | V | 1 | 0.499 |
| 1400 | 177C1CO1.664 | cgpGmo-S280 | | 1 | 0.901 |
| 1401 | 1780C1CO1.581 | cgpGmo-S281 | V | 1 | 0.909 |
| 1402 | 1801C1CO1.133 | cgpGmo-S282 | V | 1 | 0.884 |
| 1403 | 1813C1CO1.243 | cgpGmo-S283 | V | 1 | 0.83 |
| 1404 | 1831C1CO1.182 | cgpGmo-S284 | V | 1 | 0.828 |
| 1405 | 1835C1CO1.230 | cgpGmo-S285 | V | 1 | 0.543 |
| 1406 | 1838C1CO1.657 | cgpGmo-S286 | V | 1 | 0.723 |
| 1407 | 1840C1CO1.843 | cgpGmo-S287a | V | 2 | 0.98 |
| 1408 | 1840C1CO1.1060 | cgpGmo-S287b | V | 1 | 0.831 |
| 1409 | 1844C1CO1.86 | cgpGmo-S288 | | 1 | 0.657 |
| 1410 | 1851C2CO1.600 | cgpGmo-S289 | V | 1 | 0.908 |
| 1411 | 5994C2CO1.923 | cgpGmo-S29 | V | 1 | 0.521 |
| 1412 | 1866C1CO1.549 | cgpGmo-S290 | V | 1 | 0.842 |
| 1413 | 1878C1CO1.634 | cgpGmo-S291 | V | 1 | 0.808 |
| 1414 | 1880C1CO1.585 | cgpGmo-S292a | | 1 | 0.862 |
| 1415 | 1880C1CO1.679 | cgpGmo-S292b | V | 2 | 0.93 |
| 1416 | 188C1CO1.944 | cgpGmo-S293 | | 1 | 0.882 |
| 1417 | 1893C1CO1.504 | cgpGmo-S294 | V | 1 | 0.906 |
| 1418 | 189C1CO1.216 | cgpGmo-S295 | | 1 | 0.778 |
| 1419 | 1905C1CO1.95 | cgpGmo-S296 | V | 1 | 0.74 |
| 1420 | 1908C1CO1.505 | cgpGmo-S297 | V | 1 | 0.902 |
| 1421 | 1911C1CO1.133 | cgpGmo-S298 | V | 1 | 0.879 |
| 1422 | 1931C1CO1.722 | cgpGmo-S299 | | 1 | 0.78 |
| 1423 | 2099C1CO1.1415 | cgpGmo-S30 | V | 1 | 0.803 |
| 1424 | 1934C1CO1.220 | cgpGmo-S300 | V | 1 | 0.804 |
| 1425 | 1937C2CO1.890 | cgpGmo-S301 | V | 1 | 0.852 |
| 1426 | 193C2CO1.193 | cgpGmo-S302 | V | 1 | 0.815 |
| 1427 | 1940C1CO1.154 | cgpGmo-S303 | | 1 | 0.658 |
| 1428 | 194C1CO1.354 | cgpGmo-S304a | V | 2 | 0.89 |
| 1429 | 194C1CO1.498 | cgpGmo-S304b | | 1 | 0.801 |
| 1430 | 194C2CO1.363 | cgpGmo-S305 | V | 1 | 0.83 |
| 1431 | 1950C1CO1.457 | cgpGmo-S306a | V | 2 | 0.96 |
| 1432 | 1950C1CO1.551 | cgpGmo-S306b | V | 1 | 0.777 |
| 1433 | 1958C1CO1.298 | cgpGmo-S307 | | 1 | 0.859 |
| 1434 | 1962C1CO1.254 | cgpGmo-S308 | V | 1 | 0.883 |
| 1435 | 1973C1CO1.726 | cgpGmo-S309 | V | 1 | 0.896 |
| 1436 | 3134C2CO3.400 | cgpGmo-S31 | V | 1 | 0.907 |
| 1437 | 1975C1CO1.244 | cgpGmo-S310 | V | 1 | 0.745 |
| 1438 | 1985C1CO1.89 | cgpGmo-S311a | | 1 | 0.512 |
| 1439 | 1985C1CO1.537 | cgpGmo-S311b | V | 2 | 0.91 |
| 1440 | 1987C1CO1.1249 | cgpGmo-S312 | V | 1 | 0.852 |
| 1441 | 198C1CO1.206 | cgpGmo-S313 | V | 1 | 0.795 |
| 1442 | 2006C1CO1.538 | cgpGmo-S314 | V | 1 | 0.902 |
| 1443 | 2008C2CO1.96 | cgpGmo-S315 | V | 1 | 0.809 |
| 1444 | 2010C1CO1.451 | cgpGmo-S316 | V | 1 | 0.899 |
| 1445 | 2013C1CO1.894 | cgpGmo-S317 | | 1 | 0.569 |
| 1446 | 2018C1CO1.166 | cgpGmo-S318 | V | 1 | 0.621 |
| 1447 | 2020C1CO1.240 | cgpGmo-S319a | | 2 | 0.98 |
| 1448 | 2020C1CO1.363 | cgpGmo-S319b | | 1 | 0.67 |
| 1449 | 3262C1CO1.135 | cgpGmo-S32 | V | 1 | 0.752 |
| 1450 | 2024C2CO1.232 | cgpGmo-S320 | V | 1 | 0.697 |
| 1451 | 2032C2CO1.221 | cgpGmo-S321 | V | 1 | 0.912 |
| 1452 | 2040C2CO1.850 | cgpGmo-S322 | V | 1 | 0.677 |
| 1453 | 2048C1CO1.312 | cgpGmo-S324 | V | 1 | 0.662 |
| 1454 | 2055C1CO1.905 | cgpGmo-S326 | | 1 | 0.868 |
| 1455 | 2064C1CO1.454 | cgpGmo-S327 | V | 1 | 0.493 |
| 1456 | 2071C1CO1.460 | cgpGmo-S328 | V | 1 | 0.701 |
| 1457 | 2071C2CO1.599 | cgpGmo-S329 | V | 1 | 0.701 |
| 1458 | 3349C1CO1.203 | cgpGmo-S33 | | 1 | 0.875 |
| 1459 | 2079C1CO1.429 | cgpGmo-S330 | V | 1 | 0.659 |
| 1460 | 2092C1CO1.471 | cgpGmo-S331a | V | 2 | 0.96 |
| 1461 | 2092C1CO1.567 | cgpGmo-S331b | V | 1 | 0.839 |
| 1462 | 2093C1CO1.254 | cgpGmo-S332a | V | 1 | 0.76 |
| 1463 | 2093C1CO1.477 | cgpGmo-S332b | V | 2 | 0.79 |
| 1464 | 2119C2CO1.362 | cgpGmo-S333 | V | 1 | 0.859 |
| 1465 | 2126C1CO1.342 | cgpGmo-S334 | V | 1 | 0.759 |
| 1466 | 2136C1CO1.228 | cgpGmo-S335 | V | 1 | 0.68 |
| 1467 | 2173C1CO1.234 | cgpGmo-S336 | V | 1 | 0.683 |
| 1468 | 2176C1CO1.539 | cgpGmo-S337 | | 1 | 0.838 |
| 1469 | 2177C1CO1.202 | cgpGmo-S338a | V | 2 | 0.98 |
| 1470 | 2177C1CO1.354 | cgpGmo-S338b | V | 1 | 0.597 |
| 1471 | 2185C1CO1.519 | cgpGmo-S339 | V | 1 | 0.901 |
| 1472 | 2187C3CO1.371 | cgpGmo-S340a | | 1 | 0.597 |
| 1473 | 2187C3CO1.565 | cgpGmo-S340b | | 2 | 0.98 |
| 1474 | 2203C1CO1.184 | cgpGmo-S341 | V | 1 | 0.794 |
| 1475 | 2222C2CO1.288 | cgpGmo-S342 | V | 1 | 0.716 |
| 1476 | 2224C2CO1.330 | cgpGmo-S343 | | 1 | 0.682 |
| 1477 | 2254C3CO1.909 | cgpGmo-S345 | | 1 | 0.782 |
| 1478 | 2254C4CO1.617 | cgpGmo-S346a | | 1 | 0.62 |
| 1479 | 2254C4CO1.685 | cgpGmo-S346b | | 2 | 0.98 |
| 1480 | 2254C9CO1.245 | cgpGmo-S347 | V | 1 | 0.894 |
| 1481 | 2257C1CO1.434 | cgpGmo-S348 | V | 1 | 0.741 |
| 1482 | 225C1CO1.254 | cgpGmo-S349 | | 1 | 0.814 |
| 1483 | 2276C1CO1.375 | cgpGmo-S350 | V | 1 | 0.822 |
| 1484 | 2296C6CO1.459 | cgpGmo-S351 | | 1 | 0.706 |
| 1485 | 2308C2CO1.226 | cgpGmo-S352 | V | 1 | 0.726 |
| 1486 | 2319C1CO1.392 | cgpGmo-S354 | V | 1 | 0.716 |
| 1487 | 2322C1CO1.359 | cgpGmo-S355 | | 1 | 0.525 |
| 1488 | 2327C1CO1.85 | cgpGmo-S356a | | 1 | 0.629 |
| 1489 | 2327C1CO1.186 | cgpGmo-S356b | V | 2 | 0.68 |
| 1490 | 2332C1CO1.139 | cgpGmo-S357 | V | 1 | 0.623 |
| 1491 | 2340C1CO1.521 | cgpGmo-S358 | | 1 | 0.852 |
| 1492 | 2343C1CO1.854 | cgpGmo-S359 | V | 1 | 0.896 |
| 1493 | 386C1CO1.1015 | cgpGmo-S35a | V | 2 | 0.87 |
| 1494 | 386C1CO1.1108 | cgpGmo-S35b | | 1 | 0.759 |
| 1495 | 2344C1CO1.95 | cgpGmo-S360 | | 1 | 0.768 |
| 1496 | 2358C1CO1.560 | cgpGmo-S361 | V | 1 | 0.824 |
| 1497 | 235C1CO1.144 | cgpGmo-S362 | | 1 | 0.629 |
| 1498 | 2369C1CO1.769 | cgpGmo-S363 | V | 1 | 0.727 |
| 1499 | 236C1CO1.125 | cgpGmo-S364 | V | 1 | 0.828 |
| 1500 | 2374C1CO1.173 | cgpGmo-S365a | | 2 | 0.92 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1501 | 2374C1CO1.298 | cgpGmo-S365b | V | 1 | 0.903 |
| 1502 | 237C1CO1.474 | cgpGmo-S366 | V | 1 | 0.829 |
| 1503 | 2386C1CO1.430 | cgpGmo-S367 | V | 1 | 0.702 |
| 1504 | 2390C1CO1.669 | cgpGmo-S368 |   | 1 | 0.799 |
| 1505 | 2393C1CO1.600 | cgpGmo-S369 | V | 1 | 0.907 |
| 1506 | 3914C1CO1.331 | cgpGmo-S36a | V | 2 | 0.89 |
| 1507 | 3914C1CO1.466 | cgpGmo-S36b | V | 1 | 0.849 |
| 1508 | 2397C2CO1.558 | cgpGmo-S370 |   | 1 | 0.906 |
| 1509 | 23C1CO1.446 | cgpGmo-S371 | V | 1 | 0.665 |
| 1510 | 2429C1CO1.500 | cgpGmo-S372a | V | 1 | 0.454 |
| 1511 | 2429C1CO1.691 | cgpGmo-S372b |   | 2 | 0.93 |
| 1512 | 2437C1CO1.472 | cgpGmo-S373 |   | 1 | 0.465 |
| 1513 | 2440C1CO1.211 | cgpGmo-S374 | V | 1 | 0.591 |
| 1514 | 2479C1CO1.447 | cgpGmo-S375 |   | 1 | 0.914 |
| 1515 | 2485C1CO1.141 | cgpGmo-S376 | V | 1 | 0.662 |
| 1516 | 2486C1CO1.952 | cgpGmo-S377 | V | 1 | 0.796 |
| 1517 | 2489C1CO1.536 | cgpGmo-S378a |   | 1 | 0.741 |
| 1518 | 2489C1CO1.613 | cgpGmo-S378b |   | 2 | 0.84 |
| 1519 | 2509C1CO1.191 | cgpGmo-S379 |   | 1 | 0.895 |
| 1520 | 4792C1CO1.95 | cgpGmo-S37a | V | 2 | 0.97 |
| 1521 | 4792C1CO1.189 | cgpGmo-S37b | V | 1 | 0.876 |
| 1522 | 2522C1CO1.130 | cgpGmo-S380 |   | 1 | 0.845 |
| 1523 | 2525C1CO1.257 | cgpGmo-S381 | V | 1 | 0.865 |
| 1524 | 2527C1CO1.337 | cgpGmo-S382 | V | 1 | 0.891 |
| 1525 | 2531C2CO1.679 | cgpGmo-S383 |   | 1 | 0.498 |
| 1526 | 2535C1CO1.457 | cgpGmo-S384 |   | 1 | 0.757 |
| 1527 | 2539C1CO1.123 | cgpGmo-S385a | V | 1 | 0.661 |
| 1528 | 2539C1CO1.218 | cgpGmo-S385b | V | 2 | 0.87 |
| 1529 | 2542C1CO1.220 | cgpGmo-S386 | V | 1 | 0.863 |
| 1530 | 2544C1CO1.1109 | cgpGmo-S387a | V | 2 | 0.82 |
| 1531 | 2544C1CO1.1873 | cgpGmo-S387b |   | 1 | 0.701 |
| 1532 | 2545C1CO1.366 | cgpGmo-S388 | V | 1 | 0.849 |
| 1533 | 2548C1CO1.260 | cgpGmo-S389 | V | 1 | 0.899 |
| 1534 | 5440C1CO1.234 | cgpGmo-S39 | V | 1 | 0.898 |
| 1535 | 257C2CO1.76 | cgpGmo-S390a |   | 2 | 0.96 |
| 1536 | 257C2CO1.478 | cgpGmo-S390b | V | 1 | 0.884 |
| 1537 | 2580C1CO1.109 | cgpGmo-S391 | V | 1 | 0.84 |
| 1538 | 2581C1CO1.764 | cgpGmo-S392 | V | 1 | 0.75 |
| 1539 | 2582C1CO1.717 | cgpGmo-S393 | V | 1 | 0.849 |
| 1540 | 2584C1CO1.520 | cgpGmo-S394 |   | 1 | 0.629 |
| 1541 | 2596C1CO1.273 | cgpGmo-S395 | V | 1 | 0.715 |
| 1542 | 2606C1CO1.133 | cgpGmo-S396 | V | 1 | 0.613 |
| 1543 | 2609C1CO1.386 | cgpGmo-S397 | V | 1 | 0.449 |
| 1544 | 2616C1CO1.882 | cgpGmo-S398 | V | 1 | 0.833 |
| 1545 | 2617C2CO1.465 | cgpGmo-S399 | V | 1 | 0.834 |
| 1546 | 6460C1CO1.340 | cgpGmo-S4 | V | 1 | 0.46 |
| 1547 | 56C2CO1.324 | cgpGmo-S40 | V | 1 | 0.587 |
| 1548 | 2625C1CO1.237 | cgpGmo-S400 | V | 1 | 0.568 |
| 1549 | 2628C1CO1.274 | cgpGmo-S401 | V | 1 | 0.915 |
| 1550 | 2632C1CO1.566 | cgpGmo-S402 |   | 1 | 0.599 |
| 1551 | 2635C1CO1.301 | cgpGmo-S403 | V | 1 | 0.677 |
| 1552 | 2645C1CO1.352 | cgpGmo-S404a | V | 1 | 0.799 |
| 1553 | 2645C1CO1.557 | cgpGmo-S404b | V | 2 | 0.87 |
| 1554 | 2646C1CO1.695 | cgpGmo-S405a |   | 1 | 0.494 |
| 1555 | 2646C1CO1.769 | cgpGmo-S405b | V | 2 | 0.87 |
| 1556 | 2673C1CO1.439 | cgpGmo-S406 | V | 1 | 0.911 |
| 1557 | 2687C1CO1.438 | cgpGmo-S407 | V | 1 | 0.647 |
| 1558 | 2693C1CO1.678 | cgpGmo-S408 | V | 1 | 0.901 |
| 1559 | 2698C1CO1.464 | cgpGmo-S409 | V | 1 | 0.897 |
| 1560 | 5704C1CO2.488 | cgpGmo-S41 | V | 1 | 0.555 |
| 1561 | 2706C1CO1.355 | cgpGmo-S410 | V | 1 | 0.881 |
| 1562 | 270C2CO1.126 | cgpGmo-S411 |   | 1 | 0.876 |
| 1563 | 2718C2CO1.1134 | cgpGmo-S412 | V | 1 | 0.883 |
| 1564 | 2723C1CO1.364 | cgpGmo-S413 | V | 1 | 0.526 |
| 1565 | 2724C1CO1.690 | cgpGmo-S414 |   | 1 | 0.66 |
| 1566 | 2735C1CO1.390 | cgpGmo-S415 | V | 1 | 0.795 |
| 1567 | 2736C2CO1.215 | cgpGmo-S416a | V | 1 | 0.799 |
| 1568 | 2736C2CO1.493 | cgpGmo-S416b | V | 2 | 0.93 |
| 1569 | 2745C1CO1.121 | cgpGmo-S417 | V | 1 | 0.857 |
| 1570 | 2750C2CO1.1006 | cgpGmo-S418 |   | 1 | 0.822 |
| 1571 | 2752C1CO1.338 | cgpGmo-S419 | V | 1 | 0.837 |
| 1572 | 5749C1CO1.404 | cgpGmo-S42 | V | 1 | 0.413 |
| 1573 | 2756C3CO1.530 | cgpGmo-S420 | V | 1 | 0.816 |
| 1574 | 2762C1CO1.366 | cgpGmo-S421 | V | 1 | 0.784 |
| 1575 | 2764C1CO1.784 | cgpGmo-S422 | V | 1 | 0.87 |
| 1576 | 2767C1CO1.502 | cgpGmo-S423 | V | 1 | 0.793 |
| 1577 | 2770C2CO1.347 | cgpGmo-S424 | V | 1 | 0.864 |
| 1578 | 2781C3CO1.955 | cgpGmo-S425 | V | 1 | 0.849 |
| 1579 | 2793C1CO1.551 | cgpGmo-S426 | V | 1 | 0.557 |
| 1580 | 2798C2CO1.402 | cgpGmo-S427 | V | 1 | 0.843 |
| 1581 | 2805C1CO1.1000 | cgpGmo-S428 | V | 1 | 0.768 |
| 1582 | 280C1CO1.580 | cgpGmo-S429 | V | 1 | 0.905 |
| 1583 | 2814C1CO1.108 | cgpGmo-S430a | V | 2 | 0.98 |
| 1584 | 2814C1CO1.309 | cgpGmo-S430b | V | 1 | 0.728 |
| 1585 | 2818C1CO1.284 | cgpGmo-S431 | V | 1 | 0.683 |
| 1586 | 281C3CO1.82 | cgpGmo-S432 |   | 1 | 0.887 |
| 1587 | 2826C1CO1.252 | cgpGmo-S433 | V | 1 | 0.561 |
| 1588 | 2830C1CO1.138 | cgpGmo-S434a | V | 1 | 0.572 |
| 1589 | 2830C1CO1.324 | cgpGmo-S434b | V | 2 | 0.89 |
| 1590 | 2834C2CO1.556 | cgpGmo-S435 | V | 1 | 0.674 |
| 1591 | 2838C1CO1.169 | cgpGmo-S436 | V | 1 | 0.823 |
| 1592 | 2841C1CO1.368 | cgpGmo-S437 | V | 1 | 0.913 |
| 1593 | 2845C2CO1.189 | cgpGmo-S438 | V | 1 | 0.899 |
| 1594 | 2848C2CO1.512 | cgpGmo-S439 | V | 1 | 0.792 |
| 1595 | 6873C1CO1.107 | cgpGmo-S44 | V | 1 | 0.839 |
| 1596 | 2878C2CO1.535 | cgpGmo-S440 |   | 1 | 0.887 |
| 1597 | 2887C1CO1.337 | cgpGmo-S441 | V | 1 | 0.696 |
| 1598 | 2889C1CO1.517 | cgpGmo-S442a | V | 2 | 0.97 |
| 1599 | 2889C1CO1.588 | cgpGmo-S442b | V | 1 | 0.881 |
| 1600 | 288C1CO1.128 | cgpGmo-S443 | V | 1 | 0.562 |
| 1601 | 2895C1CO1.348 | cgpGmo-S444 | V | 1 | 0.503 |
| 1602 | 290C1CO1.627 | cgpGmo-S446 | V | 1 | 0.672 |
| 1603 | 2911C1CO1.553 | cgpGmo-S447 | V | 1 | 0.845 |
| 1604 | 2915C1CO1.620 | cgpGmo-S448 | V | 1 | 0.676 |
| 1605 | 2917C1CO1.596 | cgpGmo-S449a | V | 1 | 0.697 |
| 1606 | 2917C1CO1.307 | cgpGmo-S449b | V | 2 | 0.76 |
| 1607 | 7167C1CO1.101 | cgpGmo-S45 | V | 1 | 0.755 |
| 1608 | 2923C1CO1.1592 | cgpGmo-S450 |   | 1 | 0.913 |
| 1609 | 2925C1CO1.421 | cgpGmo-S451a |   | 1 | 0.804 |
| 1610 | 2925C1CO1.307 | cgpGmo-S451b |   | 2 | 0.91 |
| 1611 | 2929C2CO1.807 | cgpGmo-S452 |   | 1 | 0.69 |
| 1612 | 292C1CO1.151 | cgpGmo-S453 |   | 1 | 0.778 |
| 1613 | 2931C1CO1.307 | cgpGmo-S454 |   | 1 | 0.736 |
| 1614 | 2935C1CO1.592 | cgpGmo-S455 | V | 1 | 0.898 |
| 1615 | 293C1CO1.303 | cgpGmo-S456 |   | 1 | 0.877 |
| 1616 | 2968C1CO1.121 | cgpGmo-S458a | V | 2 | 0.93 |
| 1617 | 2968C1CO1.207 | cgpGmo-S458b |   | 1 | 0.885 |
| 1618 | 2979C1CO1.280 | cgpGmo-S459 | V | 1 | 0.785 |
| 1619 | 298C1CO1.798 | cgpGmo-S460 | V | 1 | 0.842 |
| 1620 | 2991C1CO1.142 | cgpGmo-S461 |   | 1 | 0.772 |
| 1621 | 3001C1CO1.562 | cgpGmo-S462 | V | 1 | 0.782 |
| 1622 | 3002C1CO1.163 | cgpGmo-S463a | V | 1 | 0.545 |
| 1623 | 3002C1CO1.472 | cgpGmo-S463b | V | 2 | 0.85 |
| 1624 | 3003C2CO1.143 | cgpGmo-S464 | V | 1 | 0.849 |
| 1625 | 3006C1CO1.620 | cgpGmo-S465 | V | 1 | 0.872 |
| 1626 | 3022C2CO1.138 | cgpGmo-S466 | V | 1 | 0.707 |
| 1627 | 3038C1CO1.104 | cgpGmo-S467 |   | 1 | 0.785 |
| 1628 | 3039C1CO1.87 | cgpGmo-S468 |   | 1 | 0.826 |
| 1629 | 3043C1CO1.564 | cgpGmo-S469 | V | 1 | 0.887 |
| 1630 | 9323C1CO1.317 | cgpGmo-S46a | V | 1 | 0.765 |
| 1631 | 9323C1CO1.439 | cgpGmo-S46b | V | 2 | 0.89 |
| 1632 | 10327C1CO1.345 | cgpGmo-S47 |   | 1 | 0.851 |
| 1633 | 3049C1CO1.721 | cgpGmo-S470 | V | 1 | 0.814 |
| 1634 | 3057C2CO1.742 | cgpGmo-S471 | V | 1 | 0.852 |
| 1635 | 3061C1CO1.302 | cgpGmo-S472 | V | 1 | 0.569 |
| 1636 | 3072C1CO1.137 | cgpGmo-S473 |   | 1 | 0.903 |
| 1637 | 3077C1CO1.326 | cgpGmo-S474 | V | 1 | 0.533 |
| 1638 | 3097C1CO1.589 | cgpGmo-S475 | V | 1 | 0.872 |
| 1639 | 3112C1CO1.126 | cgpGmo-S476 | V | 1 | 0.754 |
| 1640 | 3123C1CO1.522 | cgpGmo-S477 | V | 1 | 0.865 |
| 1641 | 3129C1CO1.316 | cgpGmo-S478 | V | 1 | 0.837 |
| 1642 | 3150C1CO1.167 | cgpGmo-S479 | V | 1 | 0.883 |
| 1643 | 10714C1CO1.610 | cgpGmo-S48 |   | 1 | 0.759 |
| 1644 | 3155C1CO1.1902 | cgpGmo-S480 | V | 1 | 0.869 |
| 1645 | 3157C1CO1.686 | cgpGmo-S481 | V | 1 | 0.716 |
| 1646 | 3167C1CO1.676 | cgpGmo-S482 |   | 1 | 0.693 |
| 1647 | 3197C2CO1.89 | cgpGmo-S483 |   | 1 | 0.855 |
| 1648 | 3211C1CO1.550 | cgpGmo-S485 |   | 1 | 0.866 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1649 | 321C1CO1.535 | cgpGmo-S486 | V | 1 | 0.659 |
| 1650 | 3220C1CO1.430 | cgpGmo-S487 | V | 1 | 0.823 |
| 1651 | 3230C1CO1.997 | cgpGmo-S488 | V | 1 | 0.855 |
| 1652 | 3233C2CO1.234 | cgpGmo-S489 | V | 1 | 0.857 |
| 1653 | 1126C1CO1.377 | cgpGmo-S49 | V | 1 | 0.859 |
| 1654 | 3238C1CO1.625 | cgpGmo-S490 | V | 1 | 0.791 |
| 1655 | 3244C1CO1.519 | cgpGmo-S491 | V | 1 | 0.756 |
| 1656 | 324C2CO2.536 | cgpGmo-S492 | | 1 | 0.897 |
| 1657 | 325C1CO1.835 | cgpGmo-S493 | V | 1 | 0.72 |
| 1658 | 3270C1CO1.150 | cgpGmo-S495 | V | 1 | 0.428 |
| 1659 | 3271C1CO1.491 | cgpGmo-S496 | V | 1 | 0.895 |
| 1660 | 3287C1CO1.499 | cgpGmo-S497 | V | 1 | 0.783 |
| 1661 | 328C16CO1.715 | cgpGmo-S498 | | 1 | 0.467 |
| 1662 | 3291C1CO1.521 | cgpGmo-S499 | | 1 | 0.91 |
| 1663 | 1189C1CO1.555 | cgpGmo-S50 | | 1 | 0.683 |
| 1664 | 32C1CO1.727 | cgpGmo-S500 | V | 1 | 0.913 |
| 1665 | 3315C1CO1.250 | cgpGmo-S501 | V | 1 | 0.809 |
| 1666 | 331C1CO1.327 | cgpGmo-S502 | V | 1 | 0.848 |
| 1667 | 3326C1CO1.186 | cgpGmo-S503 | V | 1 | 0.601 |
| 1668 | 3330C1CO1.353 | cgpGmo-S504 | V | 1 | 0.868 |
| 1669 | 3337C1CO1.1263 | cgpGmo-S505 | V | 1 | 0.638 |
| 1670 | 3359C1CO1.602 | cgpGmo-S507 | | 1 | 0.893 |
| 1671 | 3373C1CO1.440 | cgpGmo-S508 | V | 1 | 0.737 |
| 1672 | 3376C1CO1.606 | cgpGmo-S509 | V | 1 | 0.691 |
| 1673 | 1322C1CO1.760 | cgpGmo-S51 | | 1 | 0.793 |
| 1674 | 3377C1CO1.412 | cgpGmo-S510 | V | 1 | 0.593 |
| 1675 | 337C1CO1.374 | cgpGmo-S511a | | 1 | 0.908 |
| 1676 | 337C1CO1.592 | cgpGmo-S511b | V | 2 | 0.98 |
| 1677 | 3383C1CO1.457 | cgpGmo-S512 | V | 1 | 0.8 |
| 1678 | 3384C1CO1.157 | cgpGmo-S513 | V | 1 | 0.758 |
| 1679 | 3388C1CO1.350 | cgpGmo-S514 | V | 1 | 0.907 |
| 1680 | 3399C1CO1.407 | cgpGmo-S515 | V | 1 | 0.549 |
| 1681 | 33C2CO1.816 | cgpGmo-S516 | V | 1 | 0.663 |
| 1682 | 3402C1CO1.108 | cgpGmo-S517a | | 1 | 0.687 |
| 1683 | 3402C1CO1.591 | cgpGmo-S517b | V | 2 | 0.95 |
| 1684 | 3410C1CO1.325 | cgpGmo-S518 | V | 1 | 0.669 |
| 1685 | 341C1CO1.343 | cgpGmo-S519 | | 1 | 0.765 |
| 1686 | 1388C1CO1.162 | cgpGmo-S52 | V | 1 | 0.665 |
| 1687 | 3421C1CO1.642 | cgpGmo-S520 | V | 1 | 0.74 |
| 1688 | 3426C1CO1.249 | cgpGmo-S521a | | 2 | 0.81 |
| 1689 | 3426C1CO1.420 | cgpGmo-S521b | V | 1 | 0.708 |
| 1690 | 342C1CO1.186 | cgpGmo-S522 | | 1 | 0.78 |
| 1691 | 3445C1CO1.593 | cgpGmo-S523 | V | 1 | 0.906 |
| 1692 | 3452C4CO1.423 | cgpGmo-S524 | | 1 | 0.745 |
| 1693 | 3462C1CO1.300 | cgpGmo-S525 | V | 1 | 0.911 |
| 1694 | 3467C2CO1.503 | cgpGmo-S526 | V | 1 | 0.829 |
| 1695 | 3469C1CO1.87 | cgpGmo-S527 | | 1 | 0.864 |
| 1696 | 3472C2CO1.436 | cgpGmo-S528 | V | 1 | 0.759 |
| 1697 | 3478C1CO1.165 | cgpGmo-S529 | V | 1 | 0.638 |
| 1698 | 1667C1CO1.662 | cgpGmo-S53 | | 1 | 0.831 |
| 1699 | 3479C1CO1.279 | cgpGmo-S530a | V | 2 | 0.9 |
| 1700 | 3479C1CO1.494 | cgpGmo-S530b | | 1 | 0.65 |
| 1701 | 3500C1CO1.593 | cgpGmo-S531 | | 1 | 0.911 |
| 1702 | 3505C2CO1.243 | cgpGmo-S532 | V | 1 | 0.797 |
| 1703 | 3508C1CO1.259 | cgpGmo-S533a | | 2 | 0.95 |
| 1704 | 3508C1CO1.400 | cgpGmo-S533b | V | 1 | 0.81 |
| 1705 | 3513C8CO1.666 | cgpGmo-S534 | | 1 | 0.55 |
| 1706 | 3522C1CO1.148 | cgpGmo-S535a | V | 2 | 0.99 |
| 1707 | 3522C1CO1.330 | cgpGmo-S535b | V | 1 | 0.658 |
| 1708 | 3530C1CO1.317 | cgpGmo-S536 | V | 1 | 0.861 |
| 1709 | 3552C1CO1.717 | cgpGmo-S537 | V | 1 | 0.763 |
| 1710 | 3556C5CO1.281 | cgpGmo-S539 | V | 1 | 0.473 |
| 1711 | 1759C1CO1.591 | cgpGmo-S54 | | 1 | 0.677 |
| 1712 | 3563C1CO1.611 | cgpGmo-S540 | | 1 | 0.821 |
| 1713 | 3569C1CO1.254 | cgpGmo-S541a | V | 2 | 0.96 |
| 1714 | 3569C1CO1.391 | cgpGmo-S541b | V | 1 | 0.904 |
| 1715 | 3579C1CO1.114 | cgpGmo-S542 | V | 1 | 0.888 |
| 1716 | 357C1CO1.533 | cgpGmo-S543 | V | 1 | 0.554 |
| 1717 | 3594C1CO1.850 | cgpGmo-S544 | V | 1 | 0.761 |
| 1718 | 3599C1CO2.748 | cgpGmo-S545 | | 1 | 0.912 |
| 1719 | 359C1CO1.275 | cgpGmo-S546 | V | 1 | 0.643 |
| 1720 | 3610C1CO1.450 | cgpGmo-S547 | V | 1 | 0.668 |
| 1721 | 3648C1CO1.134 | cgpGmo-S548 | V | 1 | 0.889 |
| 1722 | 3653C1CO1.565 | cgpGmo-S549 | V | 1 | 0.863 |
| 1723 | 1795C1CO1.524 | cgpGmo-S55 | V | 1 | 0.795 |
| 1724 | 3657C1CO1.1328 | cgpGmo-S550 | V | 1 | 0.879 |
| 1725 | 365C2CO1.268 | cgpGmo-S551 | V | 1 | 0.46 |
| 1726 | 3675C1CO1.715 | cgpGmo-S552 | V | 1 | 0.652 |
| 1727 | 3678C1CO1.588 | cgpGmo-S553 | V | 1 | 0.88 |
| 1728 | 3692C1CO1.194 | cgpGmo-S554 | | 1 | 0.843 |
| 1729 | 36C19CO1.189 | cgpGmo-S555a | | 2 | 0.93 |
| 1730 | 36C19CO1.264 | cgpGmo-S555b | | 1 | 0.821 |
| 1731 | 3700C1CO1.185 | cgpGmo-S556 | V | 1 | 0.898 |
| 1732 | 3713C1CO1.312 | cgpGmo-S557 | V | 1 | 0.575 |
| 1733 | 372C3CO1.448 | cgpGmo-S558 | | 1 | 0.786 |
| 1734 | 3732C1CO1.72 | cgpGmo-S559 | V | 1 | 0.851 |
| 1735 | 1924C1CO1.537 | cgpGmo-S56 | | 1 | 0.724 |
| 1736 | 373C1CO1.221 | cgpGmo-S560 | V | 1 | 0.891 |
| 1737 | 3745C1CO1.383 | cgpGmo-S561 | V | 1 | 0.888 |
| 1738 | 3752C1CO1.308 | cgpGmo-S562 | V | 1 | 0.84 |
| 1739 | 3753C2CO1.291 | cgpGmo-S563 | V | 1 | 0.817 |
| 1740 | 3753C3CO1.413 | cgpGmo-S564 | V | 1 | 0.811 |
| 1741 | 3760C2CO1.483 | cgpGmo-S565 | V | 1 | 0.425 |
| 1742 | 3760C3CO1.508 | cgpGmo-S566 | V | 1 | 0.595 |
| 1743 | 3768C2CO1.142 | cgpGmo-S567 | | 1 | 0.524 |
| 1744 | 3780C1CO1.291 | cgpGmo-S568 | | 1 | 0.869 |
| 1745 | 3799C1CO1.161 | cgpGmo-S569 | | 1 | 0.811 |
| 1746 | 2153C2CO1.693 | cgpGmo-S57 | V | 1 | 0.767 |
| 1747 | 37C1CO1.182 | cgpGmo-S570 | | 1 | 0.845 |
| 1748 | 3804C1CO1.1043 | cgpGmo-S571 | | 1 | 0.597 |
| 1749 | 3826C1CO1.474 | cgpGmo-S572 | V | 1 | 0.779 |
| 1750 | 3833C1CO1.461 | cgpGmo-S573 | V | 1 | 0.822 |
| 1751 | 3839C1CO1.555 | cgpGmo-S574 | | 1 | 0.814 |
| 1752 | 3841C1CO1.335 | cgpGmo-S575 | V | 1 | 0.903 |
| 1753 | 3846C1CO1.881 | cgpGmo-S576 | V | 1 | 0.873 |
| 1754 | 3863C1CO1.284 | cgpGmo-S577 | V | 1 | 0.868 |
| 1755 | 3865C1CO1.138 | cgpGmo-S578 | V | 1 | 0.755 |
| 1756 | 3868C1CO1.680 | cgpGmo-S579 | V | 1 | 0.686 |
| 1757 | 3871C1CO1.249 | cgpGmo-S580 | V | 1 | 0.619 |
| 1758 | 3877C2CO1.148 | cgpGmo-S581 | V | 1 | 0.748 |
| 1759 | 388C1CO1.385 | cgpGmo-S582 | V | 1 | 0.897 |
| 1760 | 3892C1CO1.494 | cgpGmo-S583 | V | 1 | 0.807 |
| 1761 | 3899C1CO1.483 | cgpGmo-S584 | V | 1 | 0.898 |
| 1762 | 389C34CO1.88 | cgpGmo-S585a | | 2 | 0.92 |
| 1763 | 389C34CO1.187 | cgpGmo-S585b | | 1 | 0.752 |
| 1764 | 390C1CO1.202 | cgpGmo-S586 | V | 1 | 0.665 |
| 1765 | 3910C1CO1.582 | cgpGmo-S587 | V | 1 | 0.616 |
| 1766 | 3912C1CO1.393 | cgpGmo-S588 | V | 1 | 0.902 |
| 1767 | 391C1CO1.121 | cgpGmo-S589 | | 1 | 0.762 |
| 1768 | 2156C1CO1.318 | cgpGmo-S58a | | 1 | 0.841 |
| 1769 | 2156C1CO1.542 | cgpGmo-S58b | V | 2 | 0.85 |
| 1770 | 393C1CO1.208 | cgpGmo-S590 | V | 1 | 0.523 |
| 1771 | 394C3CO1.540 | cgpGmo-S591 | V | 1 | 0.878 |
| 1772 | 395C1CO1.698 | cgpGmo-S592 | V | 1 | 0.848 |
| 1773 | 3965C2CO1.185 | cgpGmo-S593 | V | 1 | 0.873 |
| 1774 | 3973C1CO1.555 | cgpGmo-S594 | V | 1 | 0.887 |
| 1775 | 3981C1CO1.219 | cgpGmo-S595 | V | 1 | 0.913 |
| 1776 | 3984C1CO1.563 | cgpGmo-S596 | V | 1 | 0.896 |
| 1777 | 3989C1CO1.629 | cgpGmo-S597 | V | 1 | 0.855 |
| 1778 | 3994C1CO1.333 | cgpGmo-S598 | | 1 | 0.91 |
| 1779 | 399C2CO1.514 | cgpGmo-S599 | V | 1 | 0.74 |
| 1780 | 2220C1CO1.459 | cgpGmo-S59a | V | 2 | 0.93 |
| 1781 | 2220C1CO1.542 | cgpGmo-S59b | | 1 | 0.603 |
| 1782 | 6924C1CO1.475 | cgpGmo-S5a | | 2 | 0.96 |
| 1783 | 6924C1CO1.891 | cgpGmo-S5b | | 1 | 0.842 |
| 1784 | 8518C1CO1.523 | cgpGmo-S6 | V | 1 | 0.857 |
| 1785 | 2281C1CO1.125 | cgpGmo-S60 | V | 1 | 0.7 |
| 1786 | 4014C1CO1.594 | cgpGmo-S600 | V | 1 | 0.791 |
| 1787 | 4028C1CO1.713 | cgpGmo-S601 | V | 1 | 0.493 |
| 1788 | 4032C1CO1.611 | cgpGmo-S602 | V | 1 | 0.84 |
| 1789 | 4042C1CO1.577 | cgpGmo-S603 | V | 1 | 0.843 |
| 1790 | 4045C1CO1.331 | cgpGmo-S604 | V | 1 | 0.847 |
| 1791 | 4063C1CO1.378 | cgpGmo-S605 | V | 1 | 0.868 |
| 1792 | 4064C1CO1.123 | cgpGmo-S606a | V | 2 | 0.91 |
| 1793 | 4064C1CO1.422 | cgpGmo-S606b | | 1 | 0.751 |
| 1794 | 4077C1CO1.438 | cgpGmo-S607 | V | 1 | 0.91 |
| 1795 | 4078C1CO1.540 | cgpGmo-S608 | V | 1 | 0.707 |
| 1796 | 4079C1CO1.533 | cgpGmo-S609 | V | 1 | 0.89 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1797 | 2317C1CO1.570 | cgpGmo-S61 | V | 1 | 0.677 |
| 1798 | 408C1CO1.173 | cgpGmo-S610 | | 1 | 0.761 |
| 1799 | 4090C2CO1.179 | cgpGmo-S611 | V | 1 | 0.854 |
| 1800 | 40C1CO1.223 | cgpGmo-S612 | | 1 | 0.914 |
| 1801 | 4109C1CO1.399 | cgpGmo-S613a | | 1 | 0.493 |
| 1802 | 4109C1CO1.558 | cgpGmo-S613b | V | 2 | 0.9 |
| 1803 | 412C2CO1.446 | cgpGmo-S614a | V | 1 | 0.669 |
| 1804 | 412C2CO1.581 | cgpGmo-S614b | V | 2 | 0.8 |
| 1805 | 415C1CO1.306 | cgpGmo-S615 | V | 1 | 0.888 |
| 1806 | 4202C1CO1.408 | cgpGmo-S616 | V | 1 | 0.805 |
| 1807 | 4206C1CO1.337 | cgpGmo-S617 | V | 1 | 0.588 |
| 1808 | 4217C1CO1.355 | cgpGmo-S618 | V | 1 | 0.58 |
| 1809 | 4218C1CO1.1046 | cgpGmo-S619 | | 1 | 0.851 |
| 1810 | 2449C1CO1.207 | cgpGmo-S62 | V | 1 | 0.672 |
| 1811 | 422C1CO1.425 | cgpGmo-S620 | | 1 | 0.666 |
| 1812 | 4232C1CO1.517 | cgpGmo-S621 | V | 1 | 0.906 |
| 1813 | 4244C1CO1.497 | cgpGmo-S622 | | 1 | 0.864 |
| 1814 | 4268C1CO1.189 | cgpGmo-S623 | V | 1 | 0.782 |
| 1815 | 4276C1CO1.120 | cgpGmo-S624 | V | 1 | 0.712 |
| 1816 | 4277C1CO1.111 | cgpGmo-S625a | | 1 | 0.812 |
| 1817 | 4277C1CO1.629 | cgpGmo-S625b | | 2 | 0.99 |
| 1818 | 4282C1CO1.389 | cgpGmo-S626a | V | 2 | 0.95 |
| 1819 | 4282C1CO1.613 | cgpGmo-S626b | V | 1 | 0.883 |
| 1820 | 4288C1CO1.320 | cgpGmo-S627 | V | 1 | 0.616 |
| 1821 | 4289C2CO1.374 | cgpGmo-S628 | V | 1 | 0.767 |
| 1822 | 4292C1CO1.580 | cgpGmo-S629 | V | 1 | 0.781 |
| 1823 | 246C1CO1.437 | cgpGmo-S63 | V | 1 | 0.453 |
| 1824 | 4296C1CO1.192 | cgpGmo-S630 | V | 1 | 0.834 |
| 1825 | 4304C1CO1.155 | cgpGmo-S631 | V | 1 | 0.756 |
| 1826 | 4307C2CO1.977 | cgpGmo-S632a | V | 2 | 0.89 |
| 1827 | 4307C2CO1.1077 | cgpGmo-S632b | V | 1 | 0.616 |
| 1828 | 430C1CO1.803 | cgpGmo-S633 | V | 1 | 0.871 |
| 1829 | 4313C1CO1.551 | cgpGmo-S634 | V | 1 | 0.575 |
| 1830 | 4322C1CO1.502 | cgpGmo-S635 | V | 1 | 0.784 |
| 1831 | 4332C1CO1.346 | cgpGmo-S636 | V | 1 | 0.901 |
| 1832 | 4335C1CO1.445 | cgpGmo-S637 | V | 1 | 0.762 |
| 1833 | 4345C1CO1.539 | cgpGmo-S638a | V | 2 | 0.98 |
| 1834 | 4345C1CO1.634 | cgpGmo-S638b | V | 1 | 0.725 |
| 1835 | 4359C1CO1.400 | cgpGmo-S639 | V | 1 | 0.764 |
| 1836 | 4367C1CO1.509 | cgpGmo-S640a | | 1 | 0.809 |
| 1837 | 4367C1CO1.896 | cgpGmo-S640b | V | 2 | 0.98 |
| 1838 | 4372C1CO1.554 | cgpGmo-S641 | | 1 | 0.915 |
| 1839 | 437C1CO1.241 | cgpGmo-S642 | V | 1 | 0.62 |
| 1840 | 4393C1CO1.574 | cgpGmo-S643a | V | 1 | 0.53 |
| 1841 | 4393C1CO1.662 | cgpGmo-S643b | V | 2 | 0.91 |
| 1842 | 4404C1CO1.224 | cgpGmo-S644 | V | 1 | 0.861 |
| 1843 | 4412C2CO1.371 | cgpGmo-S645 | | 1 | 0.662 |
| 1844 | 4415C1CO2.571 | cgpGmo-S646 | V | 1 | 0.887 |
| 1845 | 4421C1CO1.124 | cgpGmo-S647 | | 1 | 0.566 |
| 1846 | 442C1CO1.532 | cgpGmo-S648 | | 1 | 0.661 |
| 1847 | 4440C1CO1.817 | cgpGmo-S649a | V | 1 | 0.667 |
| 1848 | 4440C1CO1.1126 | cgpGmo-S649b | V | 2 | 0.7 |
| 1849 | 2690C2CO1.466 | cgpGmo-S65 | | 1 | 0.889 |
| 1850 | 4449C1CO1.162 | cgpGmo-S650a | | 2 | 0.91 |
| 1851 | 4449C1CO1.293 | cgpGmo-S650b | V | 1 | 0.879 |
| 1852 | 4458C1CO1.386 | cgpGmo-S651 | | 1 | 0.811 |
| 1853 | 445C1CO1.820 | cgpGmo-S652 | V | 1 | 0.46 |
| 1854 | 4469C1CO1.201 | cgpGmo-S653 | V | 1 | 0.875 |
| 1855 | 446C1CO1.409 | cgpGmo-S654 | | 1 | 0.499 |
| 1856 | 4484C1CO1.459 | cgpGmo-S655a | | 2 | 0.91 |
| 1857 | 4484C1CO1.568 | cgpGmo-S655b | | 1 | 0.908 |
| 1858 | 448C1CO1.858 | cgpGmo-S656 | | 1 | 0.893 |
| 1859 | 4497C1CO1.350 | cgpGmo-S657a | V | 2 | 0.93 |
| 1860 | 4497C1CO1.521 | cgpGmo-S657b | V | 1 | 0.851 |
| 1861 | 4508C2CO1.152 | cgpGmo-S658 | V | 1 | 0.823 |
| 1862 | 4511C1CO1.665 | cgpGmo-S659 | | 1 | 0.804 |
| 1863 | 2690C3CO1.239 | cgpGmo-S66 | | 1 | 0.907 |
| 1864 | 4512C2CO1.327 | cgpGmo-S660 | | 1 | 0.58 |
| 1865 | 4514C1CO1.79 | cgpGmo-S661a | V | 1 | 0.878 |
| 1866 | 4514C1CO1.690 | cgpGmo-S661b | V | 2 | 0.98 |
| 1867 | 4547C2CO1.299 | cgpGmo-S662 | | 1 | 0.781 |
| 1868 | 4558C2CO1.386 | cgpGmo-S663 | V | 1 | 0.709 |
| 1869 | 4569C2CO1.241 | cgpGmo-S664 | V | 1 | 0.749 |
| 1870 | 4571C1CO1.453 | cgpGmo-S665 | V | 1 | 0.789 |
| 1871 | 4576C1CO1.585 | cgpGmo-S666 | V | 1 | 0.794 |
| 1872 | 4591C1CO1.622 | cgpGmo-S667 | V | 1 | 0.883 |
| 1873 | 4592C1CO1.326 | cgpGmo-S668 | V | 1 | 0.898 |
| 1874 | 4603C1CO1.532 | cgpGmo-S669 | V | 1 | 0.425 |
| 1875 | 2722C3CO1.535 | cgpGmo-S67 | | 1 | 0.632 |
| 1876 | 4618C1CO1.148 | cgpGmo-S670 | V | 1 | 0.517 |
| 1877 | 4660C1CO1.434 | cgpGmo-S671 | | 1 | 0.847 |
| 1878 | 4664C2CO1.271 | cgpGmo-S672 | V | 1 | 0.635 |
| 1879 | 466C1CO1.619 | cgpGmo-S673 | V | 1 | 0.848 |
| 1880 | 466C2CO1.340 | cgpGmo-S674 | V | 1 | 0.882 |
| 1881 | 4679C1CO1.249 | cgpGmo-S675a | V | 1 | 0.908 |
| 1882 | 4679C1CO1.677 | cgpGmo-S675b | V | 2 | 0.94 |
| 1883 | 4688C1CO1.934 | cgpGmo-S676 | V | 1 | 0.562 |
| 1884 | 4688C2CO1.109 | cgpGmo-S677 | V | 1 | 0.768 |
| 1885 | 4711C2CO1.437 | cgpGmo-S679 | V | 1 | 0.759 |
| 1886 | 2906C1CO1.115 | cgpGmo-S68 | V | 1 | 0.63 |
| 1887 | 4729C1CO1.514 | cgpGmo-S680 | | 1 | 0.882 |
| 1888 | 472C1CO1.283 | cgpGmo-S681a | V | 2 | 0.96 |
| 1889 | 472C1CO1.667 | cgpGmo-S681b | V | 1 | 0.593 |
| 1890 | 4744C1CO1.242 | cgpGmo-S682 | V | 1 | 0.707 |
| 1891 | 4747C1CO1.505 | cgpGmo-S683a | V | 2 | 0.89 |
| 1892 | 4747C1CO1.627 | cgpGmo-S683b | | 1 | 0.855 |
| 1893 | 4749C1CO1.390 | cgpGmo-S684 | V | 1 | 0.856 |
| 1894 | 4755C1CO1.422 | cgpGmo-S685 | | 1 | 0.778 |
| 1895 | 4764C1CO1.123 | cgpGmo-S686a | V | 2 | 0.81 |
| 1896 | 4764C1CO1.451 | cgpGmo-S686b | V | 1 | 0.762 |
| 1897 | 4767C1CO1.360 | cgpGmo-S687 | V | 1 | 0.861 |
| 1898 | 4773C1CO1.458 | cgpGmo-S688 | V | 1 | 0.911 |
| 1899 | 4797C1CO1.419 | cgpGmo-S689 | V | 1 | 0.864 |
| 1900 | 3030C1CO1.290 | cgpGmo-S69 | | 1 | 0.887 |
| 1901 | 4809C1CO1.272 | cgpGmo-S690a | | 2 | 0.99 |
| 1902 | 4809C1CO1.334 | cgpGmo-S690b | | 1 | 0.599 |
| 1903 | 4810C1CO1.310 | cgpGmo-S691 | V | 1 | 0.837 |
| 1904 | 4817C1CO1.234 | cgpGmo-S692a | V | 1 | 0.793 |
| 1905 | 4817C1CO1.391 | cgpGmo-S692b | V | 2 | 0.91 |
| 1906 | 4818C1CO1.453 | cgpGmo-S693 | V | 1 | 0.827 |
| 1907 | 4823C1CO1.458 | cgpGmo-S694 | V | 1 | 0.716 |
| 1908 | 4824C1CO1.286 | cgpGmo-S695 | V | 1 | 0.873 |
| 1909 | 4831C2CO1.175 | cgpGmo-S696 | V | 1 | 0.642 |
| 1910 | 4852C1CO1.132 | cgpGmo-S697 | V | 1 | 0.655 |
| 1911 | 4858C1CO1.162 | cgpGmo-S698 | V | 1 | 0.899 |
| 1912 | 4866C1CO1.75 | cgpGmo-S699a | V | 2 | 0.73 |
| 1913 | 4866C1CO1.262 | cgpGmo-S699b | V | 1 | 0.593 |
| 1914 | 3132C1CO1.191 | cgpGmo-S70 | V | 1 | 0.817 |
| 1915 | 4894C1CO1.903 | cgpGmo-S700 | | 1 | 0.776 |
| 1916 | 4911C1CO1.607 | cgpGmo-S701 | V | 1 | 0.638 |
| 1917 | 4915C1CO1.272 | cgpGmo-S702a | | 2 | 0.94 |
| 1918 | 4915C1CO1.379 | cgpGmo-S702b | V | 1 | 0.458 |
| 1919 | 4925C1CO1.270 | cgpGmo-S703 | | 1 | 0.754 |
| 1920 | 4931C1CO1.625 | cgpGmo-S704 | V | 1 | 0.867 |
| 1921 | 4932C1CO1.142 | cgpGmo-S705 | | 1 | 0.856 |
| 1922 | 4936C1CO1.161 | cgpGmo-S706 | V | 1 | 0.774 |
| 1923 | 4940C1CO1.238 | cgpGmo-S707 | V | 1 | 0.589 |
| 1924 | 4946C1CO1.907 | cgpGmo-S708a | | 1 | 0.755 |
| 1925 | 4946C1CO1.988 | cgpGmo-S708b | | 2 | 0.93 |
| 1926 | 4949C1CO1.513 | cgpGmo-S709 | | 1 | 0.77 |
| 1927 | 3170C2CO1.136 | cgpGmo-S71 | V | 1 | 0.746 |
| 1928 | 4961C2CO1.220 | cgpGmo-S710 | | 1 | 0.541 |
| 1929 | 4963C1CO1.90 | cgpGmo-S711a | | 1 | 0.757 |
| 1930 | 4963C1CO1.217 | cgpGmo-S711b | V | 2 | 0.92 |
| 1931 | 496C1CO1.638 | cgpGmo-S712 | V | 1 | 0.587 |
| 1932 | 4975C1CO1.328 | cgpGmo-S713 | | 1 | 0.532 |
| 1933 | 497C1CO1.563 | cgpGmo-S714a | V | 2 | 0.77 |
| 1934 | 497C1CO1.984 | cgpGmo-S714b | | 1 | 0.72 |
| 1935 | 5002C1CO1.225 | cgpGmo-S715 | V | 1 | 0.888 |
| 1936 | 5007C1CO2.776 | cgpGmo-S716 | V | 1 | 0.89 |
| 1937 | 5040C1CO1.700 | cgpGmo-S717 | V | 1 | 0.865 |
| 1938 | 5042C1CO1.183 | cgpGmo-S718a | V | 1 | 0.828 |
| 1939 | 5042C1CO1.449 | cgpGmo-S718b | V | 2 | 0.9 |
| 1940 | 5047C2CO1.566 | cgpGmo-S719 | V | 1 | 0.721 |
| 1941 | 3204C1CO1.65 | cgpGmo-S72 | | 1 | 0.491 |
| 1942 | 5062C1CO1.277 | cgpGmo-S720 | V | 1 | 0.566 |
| 1943 | 5086C1CO1.604 | cgpGmo-S721 | | 1 | 0.889 |
| 1944 | 5114C1CO1.160 | cgpGmo-S722 | V | 1 | 0.525 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 1945 | 512C1CO1.115 | cgpGmo-S723 | V | 1 | 0.693 |
| 1946 | 513C1CO1.511 | cgpGmo-S724 |   | 1 | 0.784 |
| 1947 | 5155C1CO1.111 | cgpGmo-S725 | V | 1 | 0.883 |
| 1948 | 5162C2CO1.544 | cgpGmo-S726 | V | 1 | 0.891 |
| 1949 | 5166C1CO1.290 | cgpGmo-S727 | V | 1 | 0.786 |
| 1950 | 5172C1CO1.598 | cgpGmo-S728 | V | 1 | 0.869 |
| 1951 | 5192C1CO1.138 | cgpGmo-S729 | V | 1 | 0.882 |
| 1952 | 5222C1CO1.351 | cgpGmo-S730 | V | 1 | 0.718 |
| 1953 | 5231C1CO1.189 | cgpGmo-S731 |   | 1 | 0.904 |
| 1954 | 5235C1CO1.747 | cgpGmo-S732 |   | 1 | 0.512 |
| 1955 | 5236C1CO1.575 | cgpGmo-S733 |   | 1 | 0.751 |
| 1956 | 523C1CO1.142 | cgpGmo-S734 | V | 1 | 0.863 |
| 1957 | 5254C1CO1.287 | cgpGmo-S735 | V | 1 | 0.779 |
| 1958 | 5258C1CO1.446 | cgpGmo-S736 |   | 1 | 0.843 |
| 1959 | 5259C1CO1.525 | cgpGmo-S737 | V | 1 | 0.901 |
| 1960 | 527C1CO1.385 | cgpGmo-S739 | V | 1 | 0.496 |
| 1961 | 5284C1CO1.650 | cgpGmo-S740 | V | 1 | 0.824 |
| 1962 | 5286C1CO1.217 | cgpGmo-S741 | V | 1 | 0.903 |
| 1963 | 5289C1CO1.323 | cgpGmo-S742a | V | 1 | 0.572 |
| 1964 | 5289C1CO1.468 | cgpGmo-S742b | V | 2 | 0.83 |
| 1965 | 52C1CO1.728 | cgpGmo-S743 |   | 1 | 0.742 |
| 1966 | 5307C1CO1.406 | cgpGmo-S745 |   | 1 | 0.833 |
| 1967 | 530C1CO1.205 | cgpGmo-S746 | V | 1 | 0.885 |
| 1968 | 5315C1CO1.92 | cgpGmo-S747 | V | 1 | 0.882 |
| 1969 | 5329C1CO1.112 | cgpGmo-S748 | V | 1 | 0.792 |
| 1970 | 5332C1CO1.211 | cgpGmo-S749a | V | 1 | 0.893 |
| 1971 | 5332C1CO1.293 | cgpGmo-S749b | V | 2 | 0.94 |
| 1972 | 3467C1CO1.122 | cgpGmo-S75 | V | 1 | 0.697 |
| 1973 | 5340C1CO1.400 | cgpGmo-S750 |   | 1 | 0.693 |
| 1974 | 5363C1CO1.533 | cgpGmo-S751 | V | 1 | 0.791 |
| 1975 | 5370C1CO1.251 | cgpGmo-S752a | V | 1 | 0.523 |
| 1976 | 5370C1CO1.568 | cgpGmo-S752b | V | 2 | 0.97 |
| 1977 | 537C2CO1.785 | cgpGmo-S753 | V | 1 | 0.716 |
| 1978 | 5393C1CO1.183 | cgpGmo-S754 | V | 1 | 0.403 |
| 1979 | 5400C1CO1.436 | cgpGmo-S755 | V | 1 | 0.795 |
| 1980 | 5413C1CO1.147 | cgpGmo-S756a | V | 1 | 0.498 |
| 1981 | 5413C1CO1.375 | cgpGmo-S756b |   | 2 | 0.75 |
| 1982 | 5431C1CO1.324 | cgpGmo-S757 | V | 1 | 0.719 |
| 1983 | 5472C1CO1.337 | cgpGmo-S758 | V | 1 | 0.524 |
| 1984 | 5485C1CO1.422 | cgpGmo-S759 | V | 1 | 0.668 |
| 1985 | 3528C1CO1.616 | cgpGmo-S76 |   | 1 | 0.878 |
| 1986 | 549C1CO1.508 | cgpGmo-S760 | V | 1 | 0.906 |
| 1987 | 5512C1CO1.292 | cgpGmo-S761a |   | 1 | 0.801 |
| 1988 | 5512C1CO1.720 | cgpGmo-S761b | V | 2 | 0.88 |
| 1989 | 5519C1CO1.403 | cgpGmo-S762 | V | 1 | 0.658 |
| 1990 | 5520C1CO1.147 | cgpGmo-S763 | V | 1 | 0.708 |
| 1991 | 5527C1CO1.218 | cgpGmo-S764 | V | 1 | 0.912 |
| 1992 | 5530C1CO1.395 | cgpGmo-S765 | V | 1 | 0.723 |
| 1993 | 5533C1CO1.524 | cgpGmo-S766 |   | 1 | 0.587 |
| 1994 | 5542C1CO1.76 | cgpGmo-S767 | V | 1 | 0.915 |
| 1995 | 5575C1CO1.211 | cgpGmo-S768 | V | 1 | 0.898 |
| 1996 | 5579C1CO1.463 | cgpGmo-S769 | V | 1 | 0.905 |
| 1997 | 3597C1CO1.329 | cgpGmo-S77 | V | 1 | 0.767 |
| 1998 | 5580C1CO1.70 | cgpGmo-S770 | V | 1 | 0.889 |
| 1999 | 5587C1CO1.102 | cgpGmo-S771 | V | 1 | 0.779 |
| 2000 | 5594C1CO1.137 | cgpGmo-S772 | V | 1 | 0.59 |
| 2001 | 5595C1CO1.346 | cgpGmo-S773 | V | 1 | 0.755 |
| 2002 | 559C1CO1.603 | cgpGmo-S774 | V | 1 | 0.785 |
| 2003 | 5610C1CO1.349 | cgpGmo-S775 | V | 1 | 0.893 |
| 2004 | 5632C2CO1.375 | cgpGmo-S776a | V | 1 | 0.904 |
| 2005 | 5632C2CO1.446 | cgpGmo-S776b | V | 2 | 0.95 |
| 2006 | 5638C1CO2.466 | cgpGmo-S777 | V | 1 | 0.896 |
| 2007 | 5639C1CO1.289 | cgpGmo-S778 | V | 1 | 0.684 |
| 2008 | 5645C1CO1.1566 | cgpGmo-S779 | V | 1 | 0.86 |
| 2009 | 363C1CO1.830 | cgpGmo-S78 | V | 1 | 0.69 |
| 2010 | 5663C1CO1.173 | cgpGmo-S780 | V | 1 | 0.564 |
| 2011 | 5682C1CO1.271 | cgpGmo-S782 | V | 1 | 0.793 |
| 2012 | 5685C1CO1.95 | cgpGmo-S783a |   | 2 | 0.84 |
| 2013 | 5685C1CO1.273 | cgpGmo-S783b |   | 1 | 0.804 |
| 2014 | 5690C1CO1.709 | cgpGmo-S784 | V | 1 | 0.876 |
| 2015 | 5703C1CO1.668 | cgpGmo-S785a | V | 2 | 0.98 |
| 2016 | 5703C1CO1.864 | cgpGmo-S785b | V | 1 | 0.798 |
| 2017 | 5706C1CO1.309 | cgpGmo-S786 | V | 1 | 0.569 |
| 2018 | 570C1CO1.358 | cgpGmo-S787 | V | 1 | 0.871 |
| 2019 | 5713C1CO1.520 | cgpGmo-S788 | V | 1 | 0.855 |
| 2020 | 5724C1CO1.599 | cgpGmo-S789 |   | 1 | 0.767 |
| 2021 | 3748C1CO1.231 | cgpGmo-S79 | V | 1 | 0.712 |
| 2022 | 5736C1CO1.201 | cgpGmo-S790 |   | 1 | 0.532 |
| 2023 | 5748C2CO1.320 | cgpGmo-S791 | V | 1 | 0.786 |
| 2024 | 5771C1CO1.345 | cgpGmo-S792 | V | 1 | 0.683 |
| 2025 | 5783C1CO1.176 | cgpGmo-S793a | V | 1 | 0.731 |
| 2026 | 5783C1CO1.509 | cgpGmo-S793b |   | 2 | 0.98 |
| 2027 | 5784C1CO1.434 | cgpGmo-S794 | V | 1 | 0.889 |
| 2028 | 5794C1CO1.277 | cgpGmo-S795a |   | 2 | 0.98 |
| 2029 | 5794C1CO1.598 | cgpGmo-S795b |   | 1 | 0.822 |
| 2030 | 57C1CO1.170 | cgpGmo-S796 | V | 1 | 0.627 |
| 2031 | 5834C3CO1.565 | cgpGmo-S798 |   | 1 | 0.893 |
| 2032 | 583C1CO1.516 | cgpGmo-S799 | V | 1 | 0.77 |
| 2033 | 3852C1CO1.633 | cgpGmo-S80 |   | 1 | 0.738 |
| 2034 | 5842C1CO1.443 | cgpGmo-S800 |   | 1 | 0.666 |
| 2035 | 5856C1CO1.212 | cgpGmo-S801 |   | 1 | 0.898 |
| 2036 | 5879C1CO1.467 | cgpGmo-S802 |   | 1 | 0.738 |
| 2037 | 5880C1CO1.235 | cgpGmo-S803 | V | 1 | 0.886 |
| 2038 | 5887C1CO1.477 | cgpGmo-S804 |   | 1 | 0.849 |
| 2039 | 58C15CO1.228 | cgpGmo-S805 | V | 1 | 0.819 |
| 2040 | 5909C1CO1.1049 | cgpGmo-S807 |   | 1 | 0.843 |
| 2041 | 5923C1CO1.673 | cgpGmo-S808 | V | 1 | 0.898 |
| 2042 | 5924C1CO1.188 | cgpGmo-S809 |   | 1 | 0.823 |
| 2043 | 3888C1CO1.712 | cgpGmo-S81 | V | 1 | 0.883 |
| 2044 | 592C1CO1.539 | cgpGmo-S810 | V | 1 | 0.816 |
| 2045 | 5938C2CO1.140 | cgpGmo-S811a | V | 2 | 0.97 |
| 2046 | 5938C2CO1.657 | cgpGmo-S811b |   | 1 | 0.901 |
| 2047 | 593C1CO1.282 | cgpGmo-S812 |   | 1 | 0.862 |
| 2048 | 5943C1CO1.466 | cgpGmo-S813 | V | 1 | 0.691 |
| 2049 | 5974C1CO1.393 | cgpGmo-S814a | V | 1 | 0.902 |
| 2050 | 5974C1CO1.537 | cgpGmo-S814b | V | 2 | 0.94 |
| 2051 | 5975C1CO1.154 | cgpGmo-S815 |   | 1 | 0.668 |
| 2052 | 5978C1CO1.943 | cgpGmo-S816a | V | 2 | 0.89 |
| 2053 | 5978C1CO1.572 | cgpGmo-S816b |   | 1 | 0.869 |
| 2054 | 5981C1CO1.613 | cgpGmo-S817 | V | 1 | 0.766 |
| 2055 | 598C1CO1.305 | cgpGmo-S818a | V | 2 | 0.74 |
| 2056 | 598C1CO1.404 | cgpGmo-S818b |   | 1 | 0.698 |
| 2057 | 5995C1CO1.138 | cgpGmo-S819a |   | 1 | 0.899 |
| 2058 | 5995C1CO1.667 | cgpGmo-S819b | V | 2 | 0.9 |
| 2059 | 4043C1CO1.488 | cgpGmo-S82 | V | 1 | 0.903 |
| 2060 | 59C2CO1.325 | cgpGmo-S820 |   | 1 | 0.672 |
| 2061 | 6003C1CO1.427 | cgpGmo-S821 |   | 1 | 0.891 |
| 2062 | 6029C1CO1.93 | cgpGmo-S822a | V | 1 | 0.779 |
| 2063 | 6029C1CO1.183 | cgpGmo-S822b |   | 2 | 0.84 |
| 2064 | 6031C1CO1.666 | cgpGmo-S823 |   | 1 | 0.846 |
| 2065 | 6050C1CO1.216 | cgpGmo-S824 |   | 1 | 0.867 |
| 2066 | 606C1CO1.75 | cgpGmo-S825 |   | 1 | 0.858 |
| 2067 | 6072C1CO1.98 | cgpGmo-S826 |   | 1 | 0.548 |
| 2068 | 6077C1CO1.378 | cgpGmo-S827 |   | 1 | 0.879 |
| 2069 | 607C3CO1.460 | cgpGmo-S828 | V | 1 | 0.846 |
| 2070 | 6090C1CO1.564 | cgpGmo-S829 |   | 1 | 0.806 |
| 2071 | 4231C1CO1.400 | cgpGmo-S83 | V | 1 | 0.909 |
| 2072 | 6118C2CO1.394 | cgpGmo-S830 |   | 1 | 0.744 |
| 2073 | 6125C1CO1.618 | cgpGmo-S831 |   | 1 | 0.788 |
| 2074 | 6127C1CO1.211 | cgpGmo-S832 | V | 1 | 0.895 |
| 2075 | 6148C1CO1.396 | cgpGmo-S833 | V | 1 | 0.558 |
| 2076 | 6148C2CO1.623 | cgpGmo-S834 |   | 1 | 0.64 |
| 2077 | 6156C1CO1.442 | cgpGmo-S835 | V | 1 | 0.708 |
| 2078 | 616C1CO1.1028 | cgpGmo-S836 |   | 1 | 0.596 |
| 2079 | 6177C1CO1.317 | cgpGmo-S837 | V | 1 | 0.628 |
| 2080 | 6180C1CO1.115 | cgpGmo-S838a | V | 1 | 0.545 |
| 2081 | 6180C1CO1.266 | cgpGmo-S838b |   | 2 | 0.78 |
| 2082 | 619C1CO1.715 | cgpGmo-S839 | V | 1 | 0.912 |
| 2083 | 4399C1CO1.1210 | cgpGmo-S84 | V | 1 | 0.699 |
| 2084 | 6214C1CO1.429 | cgpGmo-S840 | V | 1 | 0.513 |
| 2085 | 6221C1CO1.330 | cgpGmo-S841 | V | 1 | 0.91 |
| 2086 | 622C2CO1.675 | cgpGmo-S842 | V | 1 | 0.805 |
| 2087 | 6240C1CO1.341 | cgpGmo-S843 |   | 1 | 0.844 |
| 2088 | 6264C1CO1.262 | cgpGmo-S844 | V | 1 | 0.889 |
| 2089 | 6311C1CO1.131 | cgpGmo-S845a |   | 1 | 0.853 |
| 2090 | 6311C1CO1.197 | cgpGmo-S845b |   | 2 | 0.91 |
| 2091 | 6316C1CO1.149 | cgpGmo-S846a |   | 2 | 0.82 |
| 2092 | 6316C1CO1.362 | cgpGmo-S846b |   | 1 | 0.716 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2093 | 6335C1CO1.469 | cgpGmo-S847 |   | 1 | 0.694 |
| 2094 | 6337C1CO1.305 | cgpGmo-S848 | V | 1 | 0.894 |
| 2095 | 6339C1CO1.418 | cgpGmo-S849 | V | 1 | 0.911 |
| 2096 | 4420C1CO1.165 | cgpGmo-S85 | V | 1 | 0.599 |
| 2097 | 6344C1CO1.431 | cgpGmo-S850 | V | 1 | 0.762 |
| 2098 | 6351C1CO1.494 | cgpGmo-S851 |   | 1 | 0.767 |
| 2099 | 6380C1CO1.242 | cgpGmo-S852 | V | 1 | 0.903 |
| 2100 | 638C1CO1.415 | cgpGmo-S853 | V | 1 | 0.865 |
| 2101 | 6390C1CO1.311 | cgpGmo-S854a |   | 1 | 0.744 |
| 2102 | 6390C1CO1.543 | cgpGmo-S854b | V | 2 | 0.87 |
| 2103 | 6399C1CO1.526 | cgpGmo-S855 | V | 1 | 0.847 |
| 2104 | 6424C1CO1.123 | cgpGmo-S856a |   | 2 | 0.98 |
| 2105 | 6424C1CO1.423 | cgpGmo-S856b |   | 1 | 0.76 |
| 2106 | 642C1CO1.329 | cgpGmo-S857 | V | 1 | 0.726 |
| 2107 | 6431C1CO1.962 | cgpGmo-S858 | V | 1 | 0.703 |
| 2108 | 6434C1CO1.441 | cgpGmo-S859 |   | 1 | 0.595 |
| 2109 | 6435C1CO1.535 | cgpGmo-S860 |   | 1 | 0.87 |
| 2110 | 6438C1CO1.481 | cgpGmo-S861 | V | 1 | 0.894 |
| 2111 | 6474C1CO1.506 | cgpGmo-S862 | V | 1 | 0.89 |
| 2112 | 650C1CO1.476 | cgpGmo-S863 | V | 1 | 0.881 |
| 2113 | 6510C1CO1.276 | cgpGmo-S864 | V | 1 | 0.737 |
| 2114 | 6511C1CO1.374 | cgpGmo-S865 | V | 1 | 0.757 |
| 2115 | 6515C1CO1.247 | cgpGmo-S866 | V | 1 | 0.585 |
| 2116 | 6527C1CO1.346 | cgpGmo-S867 | V | 1 | 0.677 |
| 2117 | 6563C1CO1.347 | cgpGmo-S868 | V | 1 | 0.798 |
| 2118 | 6585C1CO1.422 | cgpGmo-S869 | V | 1 | 0.87 |
| 2119 | 4725C1CO1.293 | cgpGmo-S87 | V | 1 | 0.785 |
| 2120 | 6596C1CO1.587 | cgpGmo-S870 | V | 1 | 0.686 |
| 2121 | 6610C2CO1.273 | cgpGmo-S871a |   | 1 | 0.865 |
| 2122 | 6610C2CO1.607 | cgpGmo-S871b |   | 2 | 0.9 |
| 2123 | 661C1CO1.665 | cgpGmo-S872a | V | 2 | 0.88 |
| 2124 | 661C1CO1.881 | cgpGmo-S872b | V | 1 | 0.827 |
| 2125 | 6629C1CO1.555 | cgpGmo-S873 | V | 1 | 0.805 |
| 2126 | 6636C1CO1.559 | cgpGmo-S874 | V | 1 | 0.53 |
| 2127 | 6645C1CO1.118 | cgpGmo-S875a |   | 2 | 0.91 |
| 2128 | 6645C1CO1.365 | cgpGmo-S875b | V | 1 | 0.753 |
| 2129 | 6645C2CO1.361 | cgpGmo-S876 | V | 1 | 0.817 |
| 2130 | 6650C1CO1.120 | cgpGmo-S877 | V | 1 | 0.896 |
| 2131 | 666C1CO1.341 | cgpGmo-S878 | V | 1 | 0.628 |
| 2132 | 6701C1CO1.248 | cgpGmo-S879 | V | 1 | 0.847 |
| 2133 | 6713C1CO1.85 | cgpGmo-S880a |   | 2 | 0.97 |
| 2134 | 6713C1CO1.169 | cgpGmo-S880b |   | 1 | 0.644 |
| 2135 | 6722C1CO1.248 | cgpGmo-S881 | V | 1 | 0.715 |
| 2136 | 6728C1CO1.428 | cgpGmo-S882a | V | 2 | 0.91 |
| 2137 | 6728C1CO1.578 | cgpGmo-S882b |   | 1 | 0.872 |
| 2138 | 672C2CO1.309 | cgpGmo-S883 | V | 1 | 0.707 |
| 2139 | 672C3CO1.292 | cgpGmo-S884 |   | 1 | 0.893 |
| 2140 | 672C4CO1.165 | cgpGmo-S885a |   | 2 | 0.89 |
| 2141 | 672C4CO1.456 | cgpGmo-S885b |   | 1 | 0.834 |
| 2142 | 6740C1CO1.430 | cgpGmo-S886 |   | 1 | 0.898 |
| 2143 | 6763C1CO1.191 | cgpGmo-S887 |   | 1 | 0.914 |
| 2144 | 6767C1CO1.246 | cgpGmo-S888 | V | 1 | 0.91 |
| 2145 | 6771C2CO1.513 | cgpGmo-S889a |   | 1 | 0.719 |
| 2146 | 6771C2CO1.598 | cgpGmo-S889b | V | 2 | 0.93 |
| 2147 | 4884C1CO1.252 | cgpGmo-S88a | V | 2 | 0.85 |
| 2148 | 4884C1CO1.316 | cgpGmo-S88b | V | 1 | 0.516 |
| 2149 | 677C1CO1.218 | cgpGmo-S890a |   | 1 | 0.631 |
| 2150 | 677C1CO1.540 | cgpGmo-S890b | V | 2 | 0.97 |
| 2151 | 6782C1CO1.172 | cgpGmo-S891 | V | 1 | 0.902 |
| 2152 | 6790C1CO1.106 | cgpGmo-S892a | V | 2 | 0.84 |
| 2153 | 6790C1CO1.272 | cgpGmo-S892b |   | 1 | 0.735 |
| 2154 | 682C1CO1.674 | cgpGmo-S893 | V | 1 | 0.887 |
| 2155 | 6830C1CO1.386 | cgpGmo-S894 | V | 1 | 0.86 |
| 2156 | 6838C1CO1.388 | cgpGmo-S895 | V | 1 | 0.857 |
| 2157 | 6840C1CO1.208 | cgpGmo-S896 | V | 1 | 0.859 |
| 2158 | 6842C1CO1.672 | cgpGmo-S897 | V | 1 | 0.788 |
| 2159 | 6859C1CO1.317 | cgpGmo-S898 |   | 1 | 0.565 |
| 2160 | 686C1CO1.408 | cgpGmo-S899 | V | 1 | 0.816 |
| 2161 | 488C2CO1.316 | cgpGmo-S89a | V | 2 | 0.94 |
| 2162 | 488C2CO1.560 | cgpGmo-S89b |   | 1 | 0.406 |
| 2163 | 690C1CO1.380 | cgpGmo-S900 | V | 1 | 0.89 |
| 2164 | 6911C1CO1.129 | cgpGmo-S901 | V | 1 | 0.782 |
| 2165 | 692C1CO1.249 | cgpGmo-S902 |   | 1 | 0.422 |
| 2166 | 6931C1CO1.136 | cgpGmo-S903a | V | 2 | 0.91 |
| 2167 | 6931C1CO1.545 | cgpGmo-S903b |   | 1 | 0.787 |
| 2168 | 6932C1CO1.138 | cgpGmo-S904 | V | 1 | 0.757 |
| 2169 | 6942C1CO1.597 | cgpGmo-S905 | V | 1 | 0.862 |
| 2170 | 6943C2CO1.435 | cgpGmo-S906 | V | 1 | 0.88 |
| 2171 | 6953C1CO1.493 | cgpGmo-S907 | V | 1 | 0.433 |
| 2172 | 6965C1CO1.344 | cgpGmo-S908 |   | 1 | 0.9 |
| 2173 | 6968C1CO1.191 | cgpGmo-S909 | V | 1 | 0.746 |
| 2174 | 511C2CO1.408 | cgpGmo-S91 | V | 1 | 0.87 |
| 2175 | 6969C1CO1.478 | cgpGmo-S910 |   | 1 | 0.796 |
| 2176 | 6980C2CO1.297 | cgpGmo-S911 | V | 1 | 0.881 |
| 2177 | 6984C1CO1.497 | cgpGmo-S912 |   | 1 | 0.533 |
| 2178 | 69C1CO1.312 | cgpGmo-S913 |   | 1 | 0.77 |
| 2179 | 7006C1CO1.376 | cgpGmo-S914 | V | 1 | 0.904 |
| 2180 | 7014C2CO1.270 | cgpGmo-S915 | V | 1 | 0.541 |
| 2181 | 7017C1CO1.142 | cgpGmo-S916 | V | 1 | 0.756 |
| 2182 | 7024C1CO1.395 | cgpGmo-S917 | V | 1 | 0.806 |
| 2183 | 7032C1CO1.377 | cgpGmo-S918 | V | 1 | 0.905 |
| 2184 | 7044C1CO1.373 | cgpGmo-S919 |   | 1 | 0.868 |
| 2185 | 5194C2CO1.996 | cgpGmo-S92 | V | 1 | 0.892 |
| 2186 | 7048C1CO1.288 | cgpGmo-S920 | V | 1 | 0.624 |
| 2187 | 7053C1CO1.238 | cgpGmo-S921 | V | 1 | 0.719 |
| 2188 | 7065C1CO1.137 | cgpGmo-S922 | V | 1 | 0.792 |
| 2189 | 7081C1CO1.561 | cgpGmo-S923 | V | 1 | 0.899 |
| 2190 | 7118C1CO1.254 | cgpGmo-S925 | V | 1 | 0.844 |
| 2191 | 7158C1CO1.350 | cgpGmo-S927 | V | 1 | 0.905 |
| 2192 | 7184C1CO1.148 | cgpGmo-S928 |   | 1 | 0.695 |
| 2193 | 718C1CO1.225 | cgpGmo-S929 | V | 1 | 0.755 |
| 2194 | 5226C1CO1.830 | cgpGmo-S93 | V | 1 | 0.768 |
| 2195 | 7201C1CO1.450 | cgpGmo-S930 | V | 1 | 0.725 |
| 2196 | 7206C1CO1.263 | cgpGmo-S931 |   | 1 | 0.801 |
| 2197 | 7212C1CO1.96 | cgpGmo-S932a |   | 2 | 0.95 |
| 2198 | 7212C1CO1.389 | cgpGmo-S932b | V | 1 | 0.884 |
| 2199 | 7222C1CO1.431 | cgpGmo-S933 |   | 1 | 0.799 |
| 2200 | 7237C1CO1.458 | cgpGmo-S934 |   | 1 | 0.879 |
| 2201 | 7244C1CO1.431 | cgpGmo-S935 |   | 1 | 0.89 |
| 2202 | 7258C1CO1.334 | cgpGmo-S936 | V | 1 | 0.849 |
| 2203 | 7261C1CO1.148 | cgpGmo-S937 | V | 1 | 0.558 |
| 2204 | 72C1CO1.1666 | cgpGmo-S938 | V | 1 | 0.723 |
| 2205 | 7302C1CO1.277 | cgpGmo-S939 | V | 1 | 0.688 |
| 2206 | 528C1CO1.1038 | cgpGmo-S94 | V | 1 | 0.647 |
| 2207 | 732C3CO1.401 | cgpGmo-S940 | V | 1 | 0.525 |
| 2208 | 7335C1CO1.265 | cgpGmo-S941 |   | 1 | 0.819 |
| 2209 | 734C1CO1.456 | cgpGmo-S942 | V | 1 | 0.791 |
| 2210 | 7352C1CO1.470 | cgpGmo-S943 | V | 1 | 0.896 |
| 2211 | 7365C1CO1.306 | cgpGmo-S944 | V | 1 | 0.913 |
| 2212 | 7392C1CO1.392 | cgpGmo-S945a | V | 2 | 0.99 |
| 2213 | 7392C1CO1.468 | cgpGmo-S945b |   | 1 | 0.762 |
| 2214 | 73C1CO1.706 | cgpGmo-S946 | V | 1 | 0.885 |
| 2215 | 7404C1CO1.161 | cgpGmo-S947 | V | 1 | 0.785 |
| 2216 | 742C1CO1.298 | cgpGmo-S948 | V | 1 | 0.913 |
| 2217 | 7435C2CO1.564 | cgpGmo-S949a | V | 1 | 0.896 |
| 2218 | 7435C2CO1.473 | cgpGmo-S949b |   | 2 | 0.95 |
| 2219 | 5347C1CO1.304 | cgpGmo-S95 |   | 1 | 0.627 |
| 2220 | 7456C1CO1.258 | cgpGmo-S951a |   | 2 | 0.91 |
| 2221 | 7456C1CO1.351 | cgpGmo-S951b | V | 1 | 0.834 |
| 2222 | 745C1CO1.258 | cgpGmo-S952a |   | 1 | 0.823 |
| 2223 | 745C1CO1.386 | cgpGmo-S952b |   | 2 | 0.93 |
| 2224 | 7487C1CO1.186 | cgpGmo-S953 | V | 1 | 0.672 |
| 2225 | 748C2CO1.399 | cgpGmo-S954 | V | 1 | 0.839 |
| 2226 | 7490C1CO1.190 | cgpGmo-S955 | V | 1 | 0.772 |
| 2227 | 7493C1CO1.126 | cgpGmo-S956 |   | 1 | 0.793 |
| 2228 | 7511C1CO1.131 | cgpGmo-S957a |   | 1 | 0.789 |
| 2229 | 7511C1CO1.400 | cgpGmo-S957b |   | 2 | 0.85 |
| 2230 | 7537C1CO1.337 | cgpGmo-S958 | V | 1 | 0.733 |
| 2231 | 7557C1CO1.413 | cgpGmo-S959 |   | 1 | 0.506 |
| 2232 | 5385C1CO1.475 | cgpGmo-S96 |   | 1 | 0.913 |
| 2233 | 7566C1CO1.225 | cgpGmo-S960 | V | 1 | 0.868 |
| 2234 | 7605C1CO1.305 | cgpGmo-S962a |   | 2 | 0.73 |
| 2235 | 7605C1CO1.433 | cgpGmo-S962b | V | 1 | 0.62 |
| 2236 | 761C1CO1.76 | cgpGmo-S963 |   | 1 | 0.85 |
| 2237 | 764C1CO1.349 | cgpGmo-S964 |   | 1 | 0.887 |
| 2238 | 7681C1CO1.185 | cgpGmo-S965 | V | 1 | 0.862 |
| 2239 | 7698C1CO1.381 | cgpGmo-S966 | V | 1 | 0.711 |
| 2240 | 7701C1CO1.175 | cgpGmo-S967a | V | 1 | 0.819 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2241 | 7701C1CO1.256 | cgpGmo-S967b | V | 2 | 0.94 |
| 2242 | 7721C1CO1.390 | cgpGmo-S968 | V | 1 | 0.877 |
| 2243 | 7730C1CO1.572 | cgpGmo-S969 |  | 1 | 0.626 |
| 2244 | 5548C1CO1.254 | cgpGmo-S97 | V | 1 | 0.819 |
| 2245 | 7739C1CO1.384 | cgpGmo-S970 |  | 1 | 0.846 |
| 2246 | 774C1CO1.610 | cgpGmo-S971 |  | 1 | 0.866 |
| 2247 | 7759C1CO1.512 | cgpGmo-S972 | V | 1 | 0.727 |
| 2248 | 775C2CO1.648 | cgpGmo-S973 | V | 1 | 0.686 |
| 2249 | 7768C1CO1.226 | cgpGmo-S974 |  | 1 | 0.876 |
| 2250 | 7769C1CO1.360 | cgpGmo-S975a | V | 2 | 0.94 |
| 2251 | 7769C1CO1.451 | cgpGmo-S975b | V | 1 | 0.909 |
| 2252 | 7785C1CO1.93 | cgpGmo-S976a | V | 1 | 0.582 |
| 2253 | 7785C1CO1.273 | cgpGmo-S976b | V | 2 | 0.82 |
| 2254 | 778C1CO1.411 | cgpGmo-S977 | V | 1 | 0.82 |
| 2255 | 7791C1CO1.314 | cgpGmo-S978 | V | 1 | 0.87 |
| 2256 | 779C1CO1.424 | cgpGmo-S979 |  | 1 | 0.88 |
| 2257 | 5978C3CO1.423 | cgpGmo-S98 | V | 1 | 0.837 |
| 2258 | 77C2CO1.470 | cgpGmo-S980 |  | 1 | 0.836 |
| 2259 | 781C1CO1.305 | cgpGmo-S982a | V | 1 | 0.889 |
| 2260 | 781C1CO1.413 | cgpGmo-S982b | V | 2 | 0.93 |
| 2261 | 7848C1CO1.416 | cgpGmo-S983 |  | 1 | 0.698 |
| 2262 | 7852C1CO1.926 | cgpGmo-S984 | V | 1 | 0.889 |
| 2263 | 7889C1CO1.405 | cgpGmo-S985 | V | 1 | 0.912 |
| 2264 | 7951C1CO1.370 | cgpGmo-S986 | V | 1 | 0.882 |
| 2265 | 7971C1CO1.254 | cgpGmo-S987a |  | 1 | 0.474 |
| 2266 | 7971C1CO1.490 | cgpGmo-S987b |  | 2 | 0.98 |
| 2267 | 7994C1CO1.144 | cgpGmo-S988 | V | 1 | 0.613 |
| 2268 | 799C3CO1.334 | cgpGmo-S989 | V | 1 | 0.822 |
| 2269 | 601C1CO1.289 | cgpGmo-S99 | V | 1 | 0.671 |
| 2270 | 8002C1CO1.427 | cgpGmo-S990 | V | 1 | 0.547 |
| 2271 | 8012C1CO1.267 | cgpGmo-S991a | V | 2 | 0.97 |
| 2272 | 8012C1CO1.350 | cgpGmo-S991b | V | 1 | 0.794 |
| 2273 | 8014C1CO1.990 | cgpGmo-S992 | V | 1 | 0.897 |
| 2274 | 8032C1CO1.827 | cgpGmo-S993 |  | 1 | 0.51 |
| 2275 | 8059C1CO1.346 | cgpGmo-S994 | V | 1 | 0.767 |
| 2276 | 8071C1CO1.187 | cgpGmo-S995a | V | 1 | 0.886 |
| 2277 | 8071C1CO1.414 | cgpGmo-S995b | V | 2 | 0.96 |
| 2278 | 8077C1CO1.314 | cgpGmo-S996 | V | 1 | 0.852 |
| 2279 | 8083C1CO1.458 | cgpGmo-S997a | V | 1 | 0.841 |
| 2280 | 8083C1CO1.621 | cgpGmo-S997b | V | 2 | 1 |
| 2281 | 8101C1CO1.399 | cgpGmo-S998 | V | 1 | 0.622 |
| 2282 | 8123C1CO1.274 | cgpGmo-S999 | V | 1 | 0.864 |
| 2283 | 10331C1CO1.490 | cgpGmo-S9a | V | 1 | 0.503 |
| 2284 | 10331C1CO1.365 | cgpGmo-S9b | V | 2 | 0.85 |
| 2285 | 891C1CO1.198 | N/A |  | 1 | 0.4 |
| 2286 | 2749C1CO1.194 | N/A |  | 1 | 0.406 |
| 2287 | 2905C1CO1.585 | N/A |  | 1 | 0.407 |
| 2288 | 6733C1CO1.91 | N/A |  | 1 | 0.408 |
| 2289 | 3341C1CO1.955 | N/A |  | 1 | 0.414 |
| 2290 | 2201C1CO1.559 | N/A |  | 1 | 0.423 |
| 2291 | 3099C1CO1.280 | N/A |  | 1 | 0.423 |
| 2292 | 1468C2CO1.476 | N/A |  | 1 | 0.429 |
| 2293 | 3618C2CO1.388 | N/A |  | 1 | 0.434 |
| 2294 | 2286C1CO1.197 | N/A |  | 1 | 0.435 |
| 2295 | 323C2CO1.532 | N/A |  | 1 | 0.436 |
| 2296 | 2722C2CO1.722 | N/A |  | 1 | 0.44 |
| 2297 | 1910C1CO1.173 | N/A |  | 1 | 0.443 |
| 2298 | 8246C1CO1.96 | N/A |  | 1 | 0.443 |
| 2299 | 157C3CO1.255 | N/A |  | 1 | 0.446 |
| 2300 | 59C1CO1.642 | N/A |  | 1 | 0.452 |
| 2301 | 8405C1CO1.591 | N/A |  | 1 | 0.457 |
| 2302 | 3767C1CO1.244 | N/A |  | 1 | 0.46 |
| 2303 | 4253C1CO1.596 | N/A |  | 1 | 0.464 |
| 2304 | 2591C3CO1.551 | N/A |  | 1 | 0.465 |
| 2305 | 1093C1CO1.405 | N/A |  | 1 | 0.471 |
| 2306 | 2756C4CO1.292 | N/A |  | 1 | 0.472 |
| 2307 | 8828C1CO1.580 | N/A |  | 1 | 0.475 |
| 2308 | 2083C1CO1.189 | N/A |  | 1 | 0.478 |
| 2309 | 1860C1CO1.251 | N/A |  | 1 | 0.488 |
| 2310 | 1998C1CO1.263 | N/A |  | 1 | 0.488 |
| 2311 | 3037C1CO1.231 | N/A |  | 1 | 0.492 |
| 2312 | 4712C1CO1.164 | N/A |  | 1 | 0.492 |
| 2313 | 1890C1CO1.155 | N/A |  | 1 | 0.494 |
| 2314 | 4819C1CO1.445 | N/A |  | 1 | 0.498 |
| 2315 | 9233C1CO1.494 | N/A |  | 1 | 0.5 |
| 2316 | 4669C1CO1.398 | N/A |  | 1 | 0.501 |
| 2317 | 10501C1CO1.168 | N/A |  | 1 | 0.502 |
| 2318 | 101C1CO1.568 | N/A |  | 1 | 0.503 |
| 2319 | 1675C3CO1.90 | N/A |  | 1 | 0.506 |
| 2320 | 3623C1CO1.407 | N/A |  | 1 | 0.509 |
| 2321 | 2993C1CO1.744 | N/A |  | 1 | 0.51 |
| 2322 | 8368C1CO1.378 | N/A |  | 1 | 0.511 |
| 2323 | 5631C1CO1.406 | N/A |  | 1 | 0.512 |
| 2324 | 5059C1CO1.184 | N/A |  | 1 | 0.519 |
| 2325 | 999C5CO1.285 | N/A |  | 1 | 0.519 |
| 2326 | 7229C1CO1.222 | N/A |  | 1 | 0.52 |
| 2327 | 2780C1CO1.165 | N/A |  | 1 | 0.524 |
| 2328 | 983C1CO1.615 | N/A |  | 1 | 0.528 |
| 2329 | 424C1CO1.648 | N/A |  | 1 | 0.529 |
| 2330 | 503C1CO1.310 | N/A |  | 1 | 0.529 |
| 2331 | 1919C1CO1.579 | N/A |  | 1 | 0.533 |
| 2332 | 3927C2CO1.745 | N/A |  | 1 | 0.533 |
| 2333 | 561C1CO1.241 | N/A |  | 1 | 0.535 |
| 2334 | 3429C2CO1.715 | N/A |  | 1 | 0.537 |
| 2335 | 4923C1CO1.395 | N/A |  | 1 | 0.538 |
| 2336 | 763C1CO1.617 | N/A |  | 1 | 0.539 |
| 2337 | 335C1CO1.530 | N/A |  | 1 | 0.54 |
| 2338 | 2420C1CO1.549 | N/A |  | 1 | 0.541 |
| 2339 | 5024C1CO1.725 | N/A |  | 1 | 0.541 |
| 2340 | 8767C1CO1.165 | N/A |  | 1 | 0.543 |
| 2341 | 1776C2CO1.290 | N/A |  | 1 | 0.545 |
| 2342 | 8478C1CO1.199 | N/A |  | 1 | 0.545 |
| 2343 | 5913C1CO1.405 | N/A |  | 1 | 0.548 |
| 2344 | 261C2CO1.80 | N/A |  | 1 | 0.551 |
| 2345 | 4225C2CO1.506 | N/A |  | 1 | 0.553 |
| 2346 | 5032C1CO1.292 | N/A |  | 1 | 0.553 |
| 2347 | 10391C1CO1.67 | N/A |  | 1 | 0.556 |
| 2348 | 3556C1CO1.112 | N/A |  | 1 | 0.557 |
| 2349 | 1371C1CO1.173 | N/A |  | 1 | 0.559 |
| 2350 | 2581C2CO1.850 | N/A |  | 1 | 0.559 |
| 2351 | 2468C1CO1.333 | N/A |  | 1 | 0.56 |
| 2352 | 6354C1CO2.207 | N/A |  | 1 | 0.561 |
| 2353 | 1809C1CO1.503 | N/A |  | 1 | 0.565 |
| 2354 | 1230C1CO1.477 | N/A |  | 1 | 0.569 |
| 2355 | 172C1CO1.143 | N/A |  | 1 | 0.57 |
| 2356 | 6672C1CO1.381 | N/A |  | 1 | 0.57 |
| 2357 | 304C1CO1.204 | N/A |  | 1 | 0.573 |
| 2358 | 3088C1CO1.988 | N/A |  | 1 | 0.575 |
| 2359 | 3252C1CO1.214 | N/A |  | 1 | 0.575 |
| 2360 | 4594C1CO1.512 | N/A |  | 1 | 0.575 |
| 2361 | 45C2CO1.81 | N/A |  | 1 | 0.575 |
| 2362 | 6720C1CO1.753 | N/A |  | 1 | 0.575 |
| 2363 | 11264C1CO1.99 | N/A |  | 1 | 0.581 |
| 2364 | 289C1CO1.129 | N/A |  | 1 | 0.582 |
| 2365 | 4354C1CO1.537 | N/A |  | 1 | 0.583 |
| 2366 | 7486C1CO1.502 | N/A |  | 1 | 0.584 |
| 2367 | 3323C1CO1.226 | N/A |  | 1 | 0.586 |
| 2368 | 10303C1CO1.226 | N/A |  | 1 | 0.587 |
| 2369 | 2898C1CO1.133 | N/A |  | 1 | 0.587 |
| 2370 | 6603C1CO1.139 | N/A |  | 1 | 0.587 |
| 2371 | 7679C1CO1.537 | N/A |  | 1 | 0.587 |
| 2372 | 2002C1CO1.492 | N/A |  | 1 | 0.588 |
| 2373 | 2107C2CO1.474 | N/A |  | 1 | 0.588 |
| 2374 | 4140C2CO1.622 | N/A |  | 1 | 0.592 |
| 2375 | 3629C2CO1.126 | N/A |  | 1 | 0.593 |
| 2376 | 4457C1CO1.413 | N/A |  | 1 | 0.596 |
| 2377 | 4969C2CO1.298 | N/A |  | 1 | 0.597 |
| 2378 | 1140C1CO1.1195 | N/A |  | 1 | 0.599 |
| 2379 | 9266C1CO1.369 | N/A |  | 1 | 0.599 |
| 2380 | 4715C1CO1.311 | N/A |  | 1 | 0.6 |
| 2381 | 2045C2CO1.270 | N/A |  | 1 | 0.601 |
| 2382 | 3741C2CO1.649 | N/A |  | 1 | 0.605 |
| 2383 | 1421C1CO1.301 | N/A |  | 1 | 0.607 |
| 2384 | 4812C1CO1.233 | N/A |  | 1 | 0.608 |
| 2385 | 7720C1CO1.639 | N/A |  | 1 | 0.61 |
| 2386 | 10744C1CO1.510 | N/A |  | 1 | 0.611 |
| 2387 | 1864C1CO1.593 | N/A |  | 1 | 0.611 |
| 2388 | 2270C1CO1.118 | N/A |  | 1 | 0.611 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2389 | 2749C2CO1.261 | N/A | | 1 | 0.611 |
| 2390 | 7532C1CO1.204 | N/A | | 1 | 0.611 |
| 2391 | 2357C2CO1.634 | N/A | | 1 | 0.613 |
| 2392 | 281C2CO1.405 | N/A | | 1 | 0.614 |
| 2393 | 1486C2CO1.138 | N/A | | 1 | 0.615 |
| 2394 | 3600C1CO1.156 | N/A | | 1 | 0.616 |
| 2395 | 7691C1CO1.612 | N/A | | 1 | 0.616 |
| 2396 | 4847C1CO1.435 | N/A | | 1 | 0.617 |
| 2397 | 269C2CO1.632 | N/A | | 1 | 0.619 |
| 2398 | 2952C2CO1.670 | N/A | | 1 | 0.621 |
| 2399 | 3295C1CO1.136 | N/A | | 1 | 0.621 |
| 2400 | 809C1CO1.380 | N/A | | 1 | 0.621 |
| 2401 | 3498C1CO1.460 | N/A | | 1 | 0.624 |
| 2402 | 4659C1CO1.346 | N/A | | 1 | 0.624 |
| 2403 | 1269C1CO1.765 | N/A | | 1 | 0.626 |
| 2404 | 692C2CO1.520 | N/A | | 1 | 0.626 |
| 2405 | 8632C1CO1.258 | N/A | | 1 | 0.626 |
| 2406 | 7552C1CO1.181 | N/A | | 1 | 0.628 |
| 2407 | 5921C1CO1.410 | N/A | | 1 | 0.629 |
| 2408 | 7695C1CO1.534 | N/A | | 1 | 0.629 |
| 2409 | 2162C2CO1.369 | N/A | | 1 | 0.631 |
| 2410 | 5432C1CO1.508 | N/A | | 1 | 0.631 |
| 2411 | 2215C1CO1.197 | N/A | | 1 | 0.632 |
| 2412 | 11538C1CO1.467 | N/A | | 1 | 0.634 |
| 2413 | 1762C1CO1.345 | N/A | | 1 | 0.634 |
| 2414 | 11309C1CO1.490 | N/A | | 1 | 0.635 |
| 2415 | 2660C1CO1.629 | N/A | | 1 | 0.636 |
| 2416 | 1790C1CO1.837 | N/A | | 1 | 0.638 |
| 2417 | 6096C1CO1.273 | N/A | | 1 | 0.638 |
| 2418 | 2867C1CO1.125 | N/A | | 1 | 0.639 |
| 2419 | 6499C1CO1.383 | N/A | | 1 | 0.639 |
| 2420 | 975C1CO1.563 | N/A | | 1 | 0.639 |
| 2421 | 5298C1CO1.326 | N/A | | 1 | 0.642 |
| 2422 | 2471C2CO1.231 | N/A | | 1 | 0.643 |
| 2423 | 774C2CO1.225 | N/A | | 1 | 0.643 |
| 2424 | 604C1CO1.553 | N/A | | 1 | 0.645 |
| 2425 | 3582C1CO1.230 | N/A | | 1 | 0.649 |
| 2426 | 3850C1CO1.202 | N/A | | 1 | 0.649 |
| 2427 | 1023C3CO1.190 | N/A | | 1 | 0.65 |
| 2428 | 2812C1CO1.221 | N/A | | 1 | 0.65 |
| 2429 | 2938C2CO1.423 | N/A | | 1 | 0.651 |
| 2430 | 4204C1CO1.304 | N/A | | 1 | 0.651 |
| 2431 | 8355C2CO1.421 | N/A | | 1 | 0.651 |
| 2432 | 8946C1CO1.375 | N/A | | 1 | 0.651 |
| 2433 | 5486C1CO1.166 | N/A | | 1 | 0.654 |
| 2434 | 655C2CO1.66 | N/A | | 1 | 0.654 |
| 2435 | 6697C1CO1.442 | N/A | | 1 | 0.654 |
| 2436 | 7427C1CO1.631 | N/A | | 1 | 0.654 |
| 2437 | 1855C1CO1.229 | N/A | | 1 | 0.657 |
| 2438 | 344C1CO1.575 | N/A | | 1 | 0.657 |
| 2439 | 1473C1CO1.206 | N/A | | 1 | 0.658 |
| 2440 | 6142C1CO1.86 | N/A | | 1 | 0.659 |
| 2441 | 4321C1CO1.310 | N/A | | 1 | 0.66 |
| 2442 | 1649C4CO1.695 | N/A | | 1 | 0.662 |
| 2443 | 2128C1CO1.1544 | N/A | | 1 | 0.662 |
| 2444 | 1310C1CO1.527 | N/A | | 1 | 0.664 |
| 2445 | 2474C1CO1.259 | N/A | | 1 | 0.667 |
| 2446 | 1202C1CO1.669 | N/A | | 1 | 0.668 |
| 2447 | 399C4CO1.275 | N/A | | 1 | 0.668 |
| 2448 | 4463C2CO1.474 | N/A | | 1 | 0.668 |
| 2449 | 7615C1CO1.648 | N/A | | 1 | 0.669 |
| 2450 | 568C2CO1.756 | N/A | | 1 | 0.67 |
| 2451 | 10614C1CO1.447 | N/A | | 1 | 0.671 |
| 2452 | 4815C1CO1.410 | N/A | | 1 | 0.672 |
| 2453 | 2113C1CO2.603 | N/A | | 1 | 0.673 |
| 2454 | 1125C1CO1.756 | N/A | | 1 | 0.675 |
| 2455 | 1608C1CO1.160 | N/A | | 1 | 0.675 |
| 2456 | 4319C1CO1.345 | N/A | | 1 | 0.675 |
| 2457 | 1746C4CO1.122 | N/A | | 1 | 0.678 |
| 2458 | 3165C1CO1.203 | N/A | | 1 | 0.678 |
| 2459 | 759C1CO1.276 | N/A | | 1 | 0.678 |
| 2460 | 860C1CO1.98 | N/A | | 1 | 0.678 |
| 2461 | 1645C1CO1.450 | N/A | | 1 | 0.679 |
| 2462 | 1051C1CO1.254 | N/A | | 1 | 0.681 |
| 2463 | 1092C2CO1.850 | N/A | | 1 | 0.682 |
| 2464 | 41C1CO1.512 | N/A | | 1 | 0.683 |
| 2465 | 4886C1CO1.510 | N/A | | 1 | 0.683 |
| 2466 | 7530C1CO1.265 | N/A | | 1 | 0.684 |
| 2467 | 3864C1CO1.555 | N/A | | 1 | 0.687 |
| 2468 | 4584C1CO1.409 | N/A | | 1 | 0.687 |
| 2469 | 5268C1CO1.214 | N/A | | 1 | 0.687 |
| 2470 | 392C1CO1.296 | N/A | | 1 | 0.689 |
| 2471 | 5382C1CO1.358 | N/A | | 1 | 0.689 |
| 2472 | 2036C1CO1.80 | N/A | | 1 | 0.69 |
| 2473 | 711C2CO1.2214 | N/A | | 1 | 0.691 |
| 2474 | 1803C1CO1.377 | N/A | | 1 | 0.694 |
| 2475 | 2405C2CO1.427 | N/A | | 1 | 0.7 |
| 2476 | 2023C1CO1.417 | N/A | | 1 | 0.703 |
| 2477 | 2368C1CO1.350 | N/A | | 1 | 0.704 |
| 2478 | 1974C1CO1.75 | N/A | | 1 | 0.708 |
| 2479 | 4709C1CO1.286 | N/A | | 1 | 0.708 |
| 2480 | 4226C1CO1.216 | N/A | | 1 | 0.709 |
| 2481 | 2325C2CO1.127 | N/A | | 1 | 0.71 |
| 2482 | 204C2CO1.348 | N/A | | 1 | 0.711 |
| 2483 | 3327C1CO1.194 | N/A | | 1 | 0.711 |
| 2484 | 1848C1CO1.464 | N/A | | 1 | 0.712 |
| 2485 | 5927C1CO1.199 | N/A | | 1 | 0.712 |
| 2486 | 7111C1CO1.456 | N/A | | 1 | 0.713 |
| 2487 | 518C1CO1.355 | N/A | | 1 | 0.714 |
| 2488 | 2091C2CO1.675 | N/A | | 1 | 0.715 |
| 2489 | 869C1CO1.706 | N/A | | 1 | 0.715 |
| 2490 | 5628C1CO1.452 | N/A | | 1 | 0.719 |
| 2491 | 2408C1CO1.590 | N/A | | 1 | 0.721 |
| 2492 | 1374C1CO1.114 | N/A | | 1 | 0.722 |
| 2493 | 3057C1CO1.784 | N/A | | 1 | 0.728 |
| 2494 | 635C1CO1.1153 | N/A | | 1 | 0.728 |
| 2495 | 114C1CO1.747 | N/A | | 1 | 0.729 |
| 2496 | 269C1CO1.511 | N/A | | 1 | 0.73 |
| 2497 | 1741C1CO1.93 | N/A | | 1 | 0.736 |
| 2498 | 9851C1CO1.401 | N/A | | 1 | 0.736 |
| 2499 | 2709C2CO1.183 | N/A | | 1 | 0.737 |
| 2500 | 5916C1CO1.276 | N/A | | 1 | 0.737 |
| 2501 | 6145C1CO1.131 | N/A | | 1 | 0.738 |
| 2502 | 7485C1CO1.680 | N/A | | 1 | 0.738 |
| 2503 | 2945C1CO1.480 | N/A | | 1 | 0.74 |
| 2504 | 1163C1CO1.1547 | N/A | | 1 | 0.743 |
| 2505 | 1295C1CO1.462 | N/A | | 1 | 0.744 |
| 2506 | 3877C1CO1.147 | N/A | | 1 | 0.744 |
| 2507 | 6299C1CO1.179 | N/A | | 1 | 0.745 |
| 2508 | 398C1CO1.211 | N/A | | 1 | 0.747 |
| 2509 | 183C1CO1.190 | N/A | | 1 | 0.748 |
| 2510 | 2696C1CO1.195 | N/A | | 1 | 0.749 |
| 2511 | 2902C2CO1.193 | N/A | | 1 | 0.749 |
| 2512 | 1310C3CO1.258 | N/A | | 1 | 0.751 |
| 2513 | 1185C1CO1.202 | N/A | | 1 | 0.756 |
| 2514 | 1356C1CO1.749 | N/A | | 1 | 0.756 |
| 2515 | 227C1CO1.166 | N/A | | 1 | 0.759 |
| 2516 | 7086C1CO1.286 | N/A | | 1 | 0.759 |
| 2517 | 5474C1CO1.179 | N/A | | 1 | 0.76 |
| 2518 | 6356C1CO1.108 | N/A | | 1 | 0.76 |
| 2519 | 5049C1CO1.746 | N/A | | 1 | 0.761 |
| 2520 | 3382C1CO1.638 | N/A | | 1 | 0.764 |
| 2521 | 3602C1CO1.637 | N/A | | 1 | 0.766 |
| 2522 | 1685C1CO1.634 | N/A | | 1 | 0.768 |
| 2523 | 3570C1CO1.104 | N/A | | 1 | 0.769 |
| 2524 | 1340C1CO1.518 | N/A | | 1 | 0.771 |
| 2525 | 1382C1CO1.158 | N/A | | 1 | 0.772 |
| 2526 | 1983C1CO1.739 | N/A | | 1 | 0.772 |
| 2527 | 2476C1CO1.494 | N/A | | 1 | 0.773 |
| 2528 | 5684C1CO1.551 | N/A | | 1 | 0.776 |
| 2529 | 10772C1CO1.194 | N/A | | 1 | 0.778 |
| 2530 | 8439C1CO1.276 | N/A | | 1 | 0.778 |
| 2531 | 8644C1CO1.221 | N/A | | 1 | 0.778 |
| 2532 | 1204C1CO1.172 | N/A | | 1 | 0.78 |
| 2533 | 1278C1CO1.241 | N/A | | 1 | 0.78 |
| 2534 | 3183C1CO1.863 | N/A | | 1 | 0.78 |
| 2535 | 5089C1CO1.354 | N/A | | 1 | 0.78 |
| 2536 | 1017C1CO1.853 | N/A | | 1 | 0.781 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2537 | 7578C1CO1.258 | N/A |  | 1 | 0.783 |
| 2538 | 1452C3CO1.252 | N/A |  | 1 | 0.786 |
| 2539 | 3560C1CO1.488 | N/A |  | 1 | 0.786 |
| 2540 | 9770C1CO1.292 | N/A |  | 1 | 0.787 |
| 2541 | 5634C1CO1.765 | N/A |  | 1 | 0.788 |
| 2542 | 3696C1CO1.2520 | N/A |  | 1 | 0.79 |
| 2543 | 4325C1CO1.90 | N/A |  | 1 | 0.79 |
| 2544 | 4806C1CO1.619 | N/A |  | 1 | 0.79 |
| 2545 | 11275C1CO1.112 | N/A |  | 1 | 0.792 |
| 2546 | 720C1CO1.363 | N/A |  | 1 | 0.792 |
| 2547 | 3425C1CO1.94 | N/A |  | 1 | 0.795 |
| 2548 | 4843C1CO1.267 | N/A |  | 1 | 0.795 |
| 2549 | 3079C1CO1.221 | N/A |  | 1 | 0.796 |
| 2550 | 4754C1CO1.553 | N/A |  | 1 | 0.798 |
| 2551 | 2311C1CO1.535 | N/A | V | 1 | 0.802 |
| 2552 | 7812C1CO1.458 | N/A |  | 1 | 0.802 |
| 2553 | 1057C1CO1.398 | N/A | V | 1 | 0.805 |
| 2554 | 708C1CO1.481 | N/A |  | 1 | 0.805 |
| 2555 | 2523C1CO1.622 | N/A |  | 1 | 0.806 |
| 2556 | 4827C2CO1.825 | N/A |  | 1 | 0.806 |
| 2557 | 468C3CO1.568 | N/A |  | 1 | 0.81 |
| 2558 | 185C1CO1.495 | N/A |  | 1 | 0.811 |
| 2559 | 914C1CO1.186 | N/A |  | 1 | 0.811 |
| 2560 | 157C2CO1.345 | N/A |  | 1 | 0.812 |
| 2561 | 730C1CO1.507 | N/A |  | 1 | 0.813 |
| 2562 | 8021C1CO1.575 | N/A |  | 1 | 0.813 |
| 2563 | 5375C2CO1.158 | N/A |  | 1 | 0.815 |
| 2564 | 129C2CO1.693 | N/A |  | 1 | 0.816 |
| 2565 | 2648C1CO1.268 | N/A |  | 1 | 0.817 |
| 2566 | 271C1CO1.182 | N/A |  | 1 | 0.817 |
| 2567 | 4635C1CO1.843 | N/A |  | 1 | 0.817 |
| 2568 | 8158C1CO1.389 | N/A |  | 1 | 0.817 |
| 2569 | 10074C1CO1.284 | N/A |  | 1 | 0.818 |
| 2570 | 4234C2CO1.544 | N/A |  | 1 | 0.818 |
| 2571 | 5636C1CO1.388 | N/A |  | 1 | 0.818 |
| 2572 | 1555C1CO1.204 | N/A |  | 1 | 0.819 |
| 2573 | 2300C1CO1.890 | N/A |  | 1 | 0.819 |
| 2574 | 5544C1CO1.586 | N/A |  | 1 | 0.819 |
| 2575 | 4510C1CO1.604 | N/A |  | 1 | 0.821 |
| 2576 | 8374C1CO1.567 | N/A |  | 1 | 0.822 |
| 2577 | 154C2CO1.200 | N/A |  | 1 | 0.824 |
| 2578 | 8125C1CO1.384 | N/A |  | 1 | 0.825 |
| 2579 | 2881C2CO1.607 | N/A |  | 1 | 0.826 |
| 2580 | 6497C1CO1.90 | N/A |  | 1 | 0.826 |
| 2581 | 6960C1CO1.121 | N/A |  | 1 | 0.827 |
| 2582 | 7947C1CO1.351 | N/A |  | 1 | 0.828 |
| 2583 | 8277C2CO1.543 | N/A |  | 1 | 0.83 |
| 2584 | 7278C1CO1.1238 | N/A |  | 1 | 0.833 |
| 2585 | 1993C1CO1.715 | N/A |  | 1 | 0.837 |
| 2586 | 2007C1CO1.619 | N/A |  | 1 | 0.837 |
| 2587 | 5350C1CO1.73 | N/A |  | 1 | 0.837 |
| 2588 | 3245C1CO1.731 | N/A |  | 1 | 0.838 |
| 2589 | 374C7CO1.270 | N/A |  | 1 | 0.84 |
| 2590 | 2293C1CO1.106 | N/A |  | 1 | 0.843 |
| 2591 | 7301C1CO1.297 | N/A |  | 1 | 0.843 |
| 2592 | 9758C1CO1.514 | N/A |  | 1 | 0.848 |
| 2593 | 7365C2CO1.331 | N/A |  | 1 | 0.849 |
| 2594 | 1413C1CO1.626 | N/A |  | 1 | 0.853 |
| 2595 | 4555C1CO1.103 | N/A |  | 1 | 0.853 |
| 2596 | 680C2CO1.90 | N/A |  | 1 | 0.853 |
| 2597 | 3340C1CO1.444 | N/A |  | 1 | 0.855 |
| 2598 | 8753C1CO1.717 | N/A |  | 1 | 0.856 |
| 2599 | 2843C1CO1.620 | N/A |  | 1 | 0.857 |
| 2600 | 1544C1CO1.719 | N/A |  | 1 | 0.86 |
| 2601 | 664C3CO1.499 | N/A |  | 1 | 0.86 |
| 2602 | 1824C1CO1.610 | N/A |  | 1 | 0.861 |
| 2603 | 5303C1CO1.105 | N/A |  | 1 | 0.861 |
| 2604 | 5341C1CO1.552 | N/A |  | 1 | 0.862 |
| 2605 | 1257C1CO1.484 | N/A |  | 1 | 0.863 |
| 2606 | 7285C1CO1.75 | N/A |  | 1 | 0.865 |
| 2607 | 3197C3CO1.245 | N/A |  | 1 | 0.866 |
| 2608 | 3319C1CO1.618 | N/A |  | 1 | 0.866 |
| 2609 | 6969C3CO1.706 | N/A |  | 1 | 0.867 |
| 2610 | 1746C2CO1.348 | N/A |  | 1 | 0.869 |
| 2611 | 4905C1CO1.228 | N/A |  | 1 | 0.869 |
| 2612 | 2568C2CO1.540 | N/A |  | 1 | 0.87 |
| 2613 | 270C1CO1.314 | N/A |  | 1 | 0.87 |
| 2614 | 4284C1CO1.645 | N/A |  | 1 | 0.87 |
| 2615 | 478C1CO1.918 | N/A |  | 1 | 0.87 |
| 2616 | 7287C1CO1.407 | N/A |  | 1 | 0.871 |
| 2617 | 7457C1CO1.324 | N/A |  | 1 | 0.872 |
| 2618 | 1367C1CO1.720 | N/A |  | 1 | 0.873 |
| 2619 | 2825C1CO1.193 | N/A |  | 1 | 0.873 |
| 2620 | 3711C1CO1.125 | N/A |  | 1 | 0.873 |
| 2621 | 1182C1CO1.629 | N/A |  | 1 | 0.874 |
| 2622 | 1327C1CO1.696 | N/A |  | 1 | 0.874 |
| 2623 | 3011C1CO1.539 | N/A |  | 1 | 0.874 |
| 2624 | 6605C2CO1.158 | N/A |  | 1 | 0.874 |
| 2625 | 967C1CO1.417 | N/A |  | 1 | 0.874 |
| 2626 | 399C3CO1.593 | N/A |  | 1 | 0.875 |
| 2627 | 5009C1CO1.158 | N/A |  | 1 | 0.875 |
| 2628 | 5911C1CO1.447 | N/A | V | 1 | 0.875 |
| 2629 | 9837C1CO1.353 | N/A |  | 1 | 0.875 |
| 2630 | 1494C1CO1.367 | N/A |  | 1 | 0.876 |
| 2631 | 8270C2CO1.386 | N/A |  | 1 | 0.876 |
| 2632 | 1258C1CO1.752 | N/A |  | 1 | 0.877 |
| 2633 | 1497C1CO1.625 | N/A |  | 1 | 0.877 |
| 2634 | 374C4CO1.754 | N/A |  | 1 | 0.877 |
| 2635 | 7183C1CO1.452 | N/A |  | 1 | 0.877 |
| 2636 | 591C2CO1.159 | N/A |  | 1 | 0.878 |
| 2637 | 2753C1CO1.698 | N/A |  | 1 | 0.879 |
| 2638 | 3539C1CO1.288 | N/A |  | 1 | 0.879 |
| 2639 | 252C1CO1.104 | N/A |  | 1 | 0.881 |
| 2640 | 5977C2CO1.98 | N/A |  | 1 | 0.881 |
| 2641 | 5760C1CO1.568 | N/A |  | 1 | 0.882 |
| 2642 | 6560C1CO1.479 | N/A |  | 1 | 0.882 |
| 2643 | 192C1CO1.309 | N/A |  | 1 | 0.883 |
| 2644 | 3194C1CO1.722 | N/A |  | 1 | 0.883 |
| 2645 | 3657C2CO1.241 | N/A |  | 1 | 0.883 |
| 2646 | 385C1CO1.91 | N/A |  | 1 | 0.883 |
| 2647 | 6178C1CO1.615 | N/A |  | 1 | 0.884 |
| 2648 | 3502C2CO1.106 | N/A |  | 1 | 0.886 |
| 2649 | 10034C1CO1.483 | N/A |  | 1 | 0.887 |
| 2650 | 3227C1CO1.424 | N/A |  | 1 | 0.887 |
| 2651 | 4559C1CO1.346 | N/A |  | 1 | 0.888 |
| 2652 | 5600C1CO1.584 | N/A |  | 1 | 0.888 |
| 2653 | 7428C1CO1.336 | N/A |  | 1 | 0.888 |
| 2654 | 856C1CO1.244 | N/A |  | 1 | 0.888 |
| 2655 | 2984C1CO1.486 | N/A |  | 1 | 0.891 |
| 2656 | 5005C1CO1.557 | N/A |  | 1 | 0.891 |
| 2657 | 554C2CO1.400 | N/A |  | 1 | 0.892 |
| 2658 | 7948C1CO1.671 | N/A |  | 1 | 0.892 |
| 2659 | 3265C1CO1.937 | N/A |  | 1 | 0.893 |
| 2660 | 3172C1CO1.337 | N/A |  | 1 | 0.895 |
| 2661 | 5617C1CO1.233 | N/A |  | 1 | 0.895 |
| 2662 | 1259C2CO1.949 | N/A |  | 1 | 0.896 |
| 2663 | 3025C1CO1.250 | N/A |  | 1 | 0.896 |
| 2664 | 413C1CO1.171 | N/A |  | 1 | 0.897 |
| 2665 | 1781C1CO1.165 | N/A |  | 1 | 0.898 |
| 2666 | 4403C1CO1.462 | N/A |  | 1 | 0.899 |
| 2667 | 4727C1CO1.65 | N/A |  | 1 | 0.899 |
| 2668 | 6048C1CO1.259 | N/A |  | 1 | 0.899 |
| 2669 | 5805C1CO1.190 | N/A |  | 1 | 0.9 |
| 2670 | 1746C9CO1.400 | N/A |  | 1 | 0.902 |
| 2671 | 432C1CO1.66 | N/A |  | 1 | 0.902 |
| 2672 | 737C2CO1.129 | N/A |  | 1 | 0.903 |
| 2673 | 1737C1CO1.118 | N/A |  | 1 | 0.904 |
| 2674 | 334C1CO1.411 | N/A | V | 1 | 0.905 |
| 2675 | 4826C1CO1.494 | N/A |  | 1 | 0.905 |
| 2676 | 7134C4CO1.167 | N/A |  | 1 | 0.905 |
| 2677 | 5279C2CO1.498 | N/A | V | 1 | 0.906 |
| 2678 | 4366C1CO1.69 | N/A |  | 1 | 0.907 |
| 2679 | 8378C1CO1.210 | N/A |  | 1 | 0.908 |
| 2680 | 1353C1CO1.580 | N/A |  | 1 | 0.909 |
| 2681 | 4140C1CO1.544 | N/A |  | 1 | 0.909 |
| 2682 | 9250C3CO1.200 | N/A |  | 1 | 0.91 |
| 2683 | 1828C1CO1.69 | N/A |  | 1 | 0.911 |
| 2684 | 3911C1CO1.598 | N/A |  | 1 | 0.911 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2685 | 3065C1CO1.184 | N/A |   | 1 | 0.913 |
| 2686 | 155C1CO1.193 | N/A | V | 1 | 0.914 |
| 2687 | 1041C1CO1.117 | N/A |   | 1 | 0.915 |
| 2688 | 5681C1CO1.227 | N/A | V | 1 | 0.915 |
| 2689 | 10186C1CO1.325 | N/A |   | 2 | 0.99 |
| 2690 | 1056C1CO2.564 | N/A |   | 2 | 0.97 |
| 2691 | 1075C2CO1.825 | N/A |   | 2 | 0.92 |
| 2692 | 1077C4CO1.661 | N/A |   | 2 | 0.98 |
| 2693 | 10964C1CO1.541 | N/A |   | 2 | 0.93 |
| 2694 | 11404C1CO1.448 | N/A |   | 2 | 0.99 |
| 2695 | 1173C3CO1.821 | N/A |   | 2 | 0.96 |
| 2696 | 11840C1CO1.335 | N/A |   | 2 | 0.93 |
| 2697 | 1188C1CO1.173 | N/A |   | 2 | 0.95 |
| 2698 | 1250C1CO1.652 | N/A |   | 2 | 0.98 |
| 2699 | 1282C1CO1.701 | N/A |   | 2 | 0.94 |
| 2700 | 1329C1CO1.626 | N/A |   | 2 | 0.95 |
| 2701 | 1352C1CO1.530 | N/A |   | 2 | 0.97 |
| 2702 | 1463C1CO1.658 | N/A |   | 2 | 0.94 |
| 2703 | 1607C1CO1.626 | N/A |   | 2 | 0.96 |
| 2704 | 1635C2CO1.135 | N/A |   | 2 | 0.99 |
| 2705 | 1664C1CO1.415 | N/A |   | 2 | 0.98 |
| 2706 | 1674C2CO1.244 | N/A |   | 2 | 0.94 |
| 2707 | 1674C4CO1.209 | N/A |   | 2 | 0.97 |
| 2708 | 176C1CO1.400 | N/A |   | 2 | 0.98 |
| 2709 | 1895C2CO1.189 | N/A |   | 2 | 0.98 |
| 2710 | 191C1CO1.719 | N/A |   | 2 | 0.97 |
| 2711 | 1937C1CO1.648 | N/A |   | 2 | 0.94 |
| 2712 | 2017C1CO1.551 | N/A |   | 2 | 0.97 |
| 2713 | 2044C1CO1.707 | N/A |   | 2 | 0.92 |
| 2714 | 2094C1CO1.230 | N/A |   | 2 | 0.94 |
| 2715 | 2109C1CO1.350 | N/A |   | 2 | 0.96 |
| 2716 | 2117C1CO1.204 | N/A |   | 2 | 0.95 |
| 2717 | 2174C1CO1.592 | N/A |   | 2 | 0.94 |
| 2718 | 224C1CO1.1503 | N/A |   | 2 | 1 |
| 2719 | 2365C2CO1.372 | N/A |   | 2 | 1 |
| 2720 | 2401C1CO1.279 | N/A |   | 2 | 0.94 |
| 2721 | 2465C1CO1.220 | N/A |   | 2 | 0.97 |
| 2722 | 2496C1CO1.195 | N/A |   | 2 | 0.95 |
| 2723 | 2534C1CO1.216 | N/A |   | 2 | 0.92 |
| 2724 | 2545C2CO1.427 | N/A |   | 2 | 0.99 |
| 2725 | 2655C1CO2.620 | N/A |   | 2 | 0.98 |
| 2726 | 2717C1CO1.618 | N/A |   | 2 | 0.93 |
| 2727 | 275C6CO1.178 | N/A |   | 2 | 0.95 |
| 2728 | 2776C2CO1.470 | N/A |   | 2 | 0.94 |
| 2729 | 2778C2CO1.623 | N/A |   | 2 | 0.94 |
| 2730 | 2813C1CO1.153 | N/A |   | 2 | 0.95 |
| 2731 | 2869C1CO1.157 | N/A |   | 2 | 0.95 |
| 2732 | 2908C1CO1.367 | N/A |   | 2 | 0.96 |
| 2733 | 2947C1CO1.267 | N/A |   | 2 | 0.93 |
| 2734 | 2959C1CO1.138 | N/A |   | 2 | 0.97 |
| 2735 | 3054C1CO1.400 | N/A |   | 2 | 0.97 |
| 2736 | 305C1CO1.448 | N/A |   | 2 | 0.93 |
| 2737 | 3142C1CO1.828 | N/A |   | 2 | 0.93 |
| 2738 | 3228C1CO1.298 | N/A |   | 2 | 0.97 |
| 2739 | 3241C1CO1.506 | N/A |   | 2 | 0.93 |
| 2740 | 3243C1CO1.585 | N/A |   | 2 | 1 |
| 2741 | 3251C2CO1.342 | N/A |   | 2 | 0.98 |
| 2742 | 3342C1CO1.133 | N/A |   | 2 | 0.98 |
| 2743 | 3343C2CO1.592 | N/A |   | 2 | 0.95 |
| 2744 | 3387C1CO1.362 | N/A |   | 2 | 0.97 |
| 2745 | 33C1CO1.662 | N/A |   | 2 | 0.93 |
| 2746 | 3427C1CO1.336 | N/A |   | 2 | 0.92 |
| 2747 | 3491C1CO1.144 | N/A |   | 2 | 0.99 |
| 2748 | 3601C1CO1.533 | N/A |   | 2 | 0.97 |
| 2749 | 3642C1CO1.505 | N/A |   | 2 | 0.92 |
| 2750 | 3674C1CO1.154 | N/A |   | 2 | 0.94 |
| 2751 | 367C1CO1.110 | N/A |   | 2 | 0.96 |
| 2752 | 3689C1CO1.314 | N/A |   | 2 | 0.94 |
| 2753 | 3744C1CO1.304 | N/A |   | 2 | 0.96 |
| 2754 | 3754C1CO1.818 | N/A |   | 2 | 0.93 |
| 2755 | 3918C1CO1.516 | N/A |   | 2 | 0.96 |
| 2756 | 410C1CO1.197 | N/A |   | 2 | 0.97 |
| 2757 | 4209C1CO1.572 | N/A |   | 2 | 0.95 |
| 2758 | 4338C1CO1.352 | N/A |   | 2 | 0.98 |
| 2759 | 4526C1CO1.533 | N/A |   | 2 | 0.94 |
| 2760 | 4548C1CO1.595 | N/A |   | 2 | 0.94 |
| 2761 | 4558C1CO1.72 | N/A |   | 2 | 0.94 |
| 2762 | 4574C1CO1.241 | N/A |   | 2 | 0.93 |
| 2763 | 4599C1CO1.497 | N/A |   | 2 | 0.94 |
| 2764 | 4625C1CO1.478 | N/A |   | 2 | 0.94 |
| 2765 | 463C2CO1.350 | N/A |   | 2 | 0.98 |
| 2766 | 4737C1CO1.570 | N/A |   | 2 | 0.93 |
| 2767 | 4838C1CO1.110 | N/A |   | 2 | 0.97 |
| 2768 | 4987C1CO1.159 | N/A |   | 2 | 0.95 |
| 2769 | 4990C1CO1.448 | N/A |   | 2 | 0.94 |
| 2770 | 5037C1CO1.400 | N/A |   | 2 | 0.94 |
| 2771 | 5065C1CO1.1120 | N/A |   | 2 | 0.92 |
| 2772 | 5192C2CO1.487 | N/A |   | 2 | 0.94 |
| 2773 | 5237C1CO1.579 | N/A |   | 2 | 0.99 |
| 2774 | 5262C1CO1.630 | N/A |   | 2 | 0.96 |
| 2775 | 5338C1CO1.309 | N/A |   | 2 | 0.96 |
| 2776 | 552C2CO1.103 | N/A |   | 2 | 0.98 |
| 2777 | 5584C1CO1.275 | N/A |   | 2 | 0.93 |
| 2778 | 5632C1CO1.454 | N/A |   | 2 | 0.97 |
| 2779 | 5731C1CO1.382 | N/A |   | 2 | 0.99 |
| 2780 | 5737C1CO1.296 | N/A |   | 2 | 0.92 |
| 2781 | 5780C1CO1.363 | N/A |   | 2 | 0.94 |
| 2782 | 5788C1CO1.63 | N/A |   | 2 | 0.97 |
| 2783 | 6001C1CO1.100 | N/A |   | 2 | 0.93 |
| 2784 | 6163C1CO1.467 | N/A |   | 2 | 0.99 |
| 2785 | 6226C1CO1.600 | N/A |   | 2 | 0.94 |
| 2786 | 6270C1CO1.474 | N/A |   | 2 | 0.97 |
| 2787 | 6274C1CO1.406 | N/A |   | 2 | 0.93 |
| 2788 | 6290C1CO1.647 | N/A |   | 2 | 0.93 |
| 2789 | 6395C1CO1.212 | N/A |   | 2 | 0.96 |
| 2790 | 6481C1CO1.371 | N/A |   | 2 | 0.95 |
| 2791 | 6521C1CO1.246 | N/A |   | 2 | 0.98 |
| 2792 | 6638C1CO1.607 | N/A |   | 2 | 0.97 |
| 2793 | 6690C2CO1.719 | N/A |   | 2 | 0.94 |
| 2794 | 6750C1CO1.261 | N/A |   | 2 | 0.95 |
| 2795 | 6775C1CO1.425 | N/A |   | 2 | 0.96 |
| 2796 | 6779C1CO1.517 | N/A |   | 2 | 0.97 |
| 2797 | 6884C1CO1.451 | N/A |   | 2 | 0.92 |
| 2798 | 7016C1CO1.439 | N/A |   | 2 | 0.98 |
| 2799 | 7046C2CO1.461 | N/A |   | 2 | 0.99 |
| 2800 | 7196C1CO1.547 | N/A |   | 2 | 0.92 |
| 2801 | 725C1CO1.113 | N/A |   | 2 | 0.97 |
| 2802 | 7329C1CO1.675 | N/A |   | 2 | 0.92 |
| 2803 | 735C1CO1.72 | N/A |   | 2 | 0.96 |
| 2804 | 738C1CO1.676 | N/A |   | 2 | 0.94 |
| 2805 | 750C1CO1.195 | N/A |   | 2 | 0.92 |
| 2806 | 7550C1CO1.284 | N/A |   | 2 | 0.96 |
| 2807 | 7760C1CO1.463 | N/A |   | 2 | 0.99 |
| 2808 | 7842C1CO1.547 | N/A |   | 2 | 0.98 |
| 2809 | 7861C1CO1.223 | N/A |   | 2 | 0.94 |
| 2810 | 7991C1CO1.1011 | N/A |   | 2 | 0.95 |
| 2811 | 7C1CO1.239 | N/A |   | 2 | 0.98 |
| 2812 | 8122C1CO1.105 | N/A |   | 2 | 0.93 |
| 2813 | 8245C1CO1.622 | N/A |   | 2 | 0.94 |
| 2814 | 833C1CO1.77 | N/A |   | 2 | 0.97 |
| 2815 | 8620C1CO1.717 | N/A |   | 2 | 0.95 |
| 2816 | 8648C1CO1.494 | N/A |   | 2 | 0.94 |
| 2817 | 8732C1CO1.246 | N/A |   | 2 | 0.94 |
| 2818 | 879C3CO1.1643 | N/A |   | 2 | 0.97 |
| 2819 | 882C2CO1.496 | N/A |   | 2 | 0.99 |
| 2820 | 900C2CO1.178 | N/A |   | 2 | 0.94 |
| 2821 | 9018C1CO1.386 | N/A |   | 2 | 0.92 |
| 2822 | 9229C2CO1.536 | N/A |   | 2 | 0.99 |
| 2823 | 9301C1CO1.183 | N/A |   | 2 | 0.92 |
| 2824 | 9519C1CO1.358 | N/A |   | 2 | 0.93 |
| 2825 | 969C1CO1.498 | N/A |   | 2 | 0.94 |
| 2826 | 9798C1CO1.854 | N/A |   | 2 | 0.97 |
| 2827 | 9910C1CO1.377 | N/A |   | 2 | 0.98 |
| 2828 | 999C1CO1.146 | N/A |   | 2 | 0.95 |
| 2829 | 118C1CO1.496 | N/A |   | 2 | 0.9 |
| 2830 | 1565C1CO1.430 | N/A |   | 2 | 0.94 |
| 2831 | 1806C1CO1.488 | N/A |   | 2 | 0.53 |
| 2832 | 2226C1CO1.292 | N/A |   | 2 | 1 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2833 | 2629C1CO1.190 | N/A | | 2 | 1 |
| 2834 | 3643C1CO1.139 | N/A | | 2 | 0.73 |
| 2835 | 3811C1CO1.336 | N/A | | 2 | 0.92 |
| 2836 | 4017C1CO1.643 | N/A | | 2 | 0.79 |
| 2837 | 4425C1CO1.1015 | N/A | | 2 | 0.59 |
| 2838 | 5177C1CO1.326 | N/A | | 2 | 0.78 |
| 2839 | 6441C1CO1.586 | N/A | | 2 | 0.94 |
| 2840 | 8256C1CO1.126 | N/A | | 2 | 0.91 |
| 2841 | 8549C2CO1.636 | N/A | | 2 | 0.98 |
| 2842 | 8771C1CO1.438 | N/A | | 2 | 0.89 |
| 2843 | 1140C1CO1.1634 | N/A | | 2 | 0.95 |
| 2844 | 1556C1CO1.146 | N/A | | 2 | 0.7 |
| 2845 | 2218C1CO1.268 | N/A | | 2 | 0.94 |
| 2846 | 2818C1CO1.432 | N/A | | 2 | 0.91 |
| 2847 | 2968C1CO1.276 | N/A | | 2 | 0.98 |
| 2848 | 3384C1CO1.95 | N/A | | 2 | 0.98 |
| 2849 | 3778C1CO1.290 | N/A | | 2 | 0.99 |
| 2850 | 4420C1CO1.321 | N/A | | 2 | 0.89 |
| 2851 | 4925C1CO1.341 | N/A | | 2 | 0.77 |
| 2852 | 5037C1CO1.339 | N/A | | 2 | 0.99 |
| 2853 | 607C3CO1.388 | N/A | | 2 | 0.92 |
| 2854 | 6649C2CO1.145 | N/A | | 2 | 0.96 |
| 2855 | 8021C1CO1.642 | N/A | | 2 | 0.97 |
| 2856 | 8622C1CO1.395 | N/A | | 2 | 0.75 |
| 2857 | 943C2CO1.598 | N/A | | 2 | 0.97 |
| 2858 | 947C3CO1.337 | N/A | | 2 | 0.98 |
| 2859 | 1092C2CO1.590 | N/A | | 2 | 0.93 |
| 2860 | 114C1CO1.553 | N/A | | 2 | 0.92 |
| 2861 | 11538C1CO1.256 | N/A | | 2 | 0.86 |
| 2862 | 1185C1CO1.588 | N/A | | 2 | 0.94 |
| 2863 | 1269C1CO1.518 | N/A | | 2 | 0.96 |
| 2864 | 1310C1CO1.170 | N/A | | 2 | 0.75 |
| 2865 | 1468C2CO1.142 | N/A | | 2 | 0.76 |
| 2866 | 1473C1CO1.321 | N/A | | 2 | 0.87 |
| 2867 | 1486C2CO1.280 | N/A | | 2 | 0.77 |
| 2868 | 1544C1CO1.650 | N/A | | 2 | 0.87 |
| 2869 | 1746C2CO1.463 | N/A | | 2 | 0.99 |
| 2870 | 1828C1CO1.331 | N/A | | 2 | 0.97 |
| 2871 | 1998C1CO1.377 | N/A | | 2 | 0.88 |
| 2872 | 2007C1CO1.139 | N/A | | 2 | 0.99 |
| 2873 | 2128C1CO1.1392 | N/A | | 2 | 0.86 |
| 2874 | 2162C2CO1.537 | N/A | | 2 | 0.78 |
| 2875 | 2201C1CO1.217 | N/A | | 2 | 0.83 |
| 2876 | 2368C1CO1.142 | N/A | | 2 | 0.87 |
| 2877 | 2591C3CO1.735 | N/A | | 2 | 0.93 |
| 2878 | 2696C1CO1.271 | N/A | | 2 | 0.83 |
| 2879 | 269C1CO1.137 | N/A | | 2 | 0.95 |
| 2880 | 269C2CO1.122 | N/A | | 2 | 0.97 |
| 2881 | 270C1CO1.247 | N/A | | 2 | 0.94 |
| 2882 | 2867C1CO1.209 | N/A | | 2 | 0.98 |
| 2883 | 2905C1CO1.706 | N/A | | 2 | 0.98 |
| 2884 | 3382C1CO1.104 | N/A | | 2 | 0.92 |
| 2885 | 3425C1CO1.652 | N/A | | 2 | 0.95 |
| 2886 | 3623C1CO1.327 | N/A | | 2 | 0.86 |
| 2887 | 374C4CO1.425 | N/A | | 2 | 0.9 |
| 2888 | 4463C2CO1.215 | N/A | | 2 | 0.83 |
| 2889 | 4709C1CO1.498 | N/A | | 2 | 0.81 |
| 2890 | 4819C1CO1.575 | N/A | | 2 | 0.85 |
| 2891 | 4886C1CO1.418 | N/A | | 2 | 0.87 |
| 2892 | 5032C1CO1.693 | N/A | | 2 | 0.7 |
| 2893 | 561C1CO1.550 | N/A | | 2 | 0.96 |
| 2894 | 59C1CO1.347 | N/A | | 2 | 0.85 |
| 2895 | 708C1CO1.696 | N/A | | 2 | 0.84 |
| 2896 | 711C2CO1.2054 | N/A | | 2 | 0.83 |
| 2897 | 7134C4CO1.245 | N/A | | 2 | 0.98 |
| 2898 | 7301C1CO1.520 | N/A | | 2 | 0.84 |
| 2899 | 7365C2CO1.672 | N/A | | 2 | 0.86 |
| 2900 | 7457C1CO1.225 | N/A | | 2 | 0.93 |
| 2901 | 7532C1CO1.349 | N/A | | 2 | 0.85 |
| 2902 | 7552C1CO1.441 | N/A | | 2 | 0.68 |
| 2903 | 763C1CO1.711 | N/A | | 2 | 0.71 |
| 2904 | 809C1CO1.248 | N/A | | 2 | 0.89 |
| 2905 | 8246C1CO1.187 | N/A | | 2 | 0.9 |
| 2906 | 8277C2CO1.480 | N/A | | 2 | 0.91 |
| 2907 | 8478C1CO1.416 | N/A | | 2 | 0.92 |
| 2908 | 8632C1CO1.372 | N/A | | 2 | 0.71 |
| 2909 | 10554C1CO1.686 | N/A | | 2 | 0.92 |
| 2910 | 1055C2CO1.119 | N/A | | 2 | 0.97 |
| 2911 | 1111C2CO1.358 | N/A | | 2 | 0.76 |
| 2912 | 1145C2CO1.609 | N/A | | 2 | 0.75 |
| 2913 | 1148C2CO1.723 | N/A | | 2 | 0.46 |
| 2914 | 1170C1CO1.616 | N/A | | 2 | 0.51 |
| 2915 | 1184C2CO1.455 | N/A | | 2 | 0.55 |
| 2916 | 1209C2CO1.126 | N/A | | 2 | 0.56 |
| 2917 | 121C1CO1.435 | N/A | | 2 | 0.89 |
| 2918 | 1239C2CO1.137 | N/A | | 2 | 0.56 |
| 2919 | 1443C1CO1.536 | N/A | | 2 | 0.77 |
| 2920 | 1513C1CO1.145 | N/A | | 2 | 0.53 |
| 2921 | 1583C1CO1.1144 | N/A | | 2 | 0.63 |
| 2922 | 1584C2CO1.930 | N/A | | 2 | 0.66 |
| 2923 | 1618C1CO1.604 | N/A | | 2 | 0.66 |
| 2924 | 1676C1CO1.203 | N/A | | 2 | 0.72 |
| 2925 | 1713C1CO1.242 | N/A | | 2 | 0.98 |
| 2926 | 1724C1CO1.359 | N/A | | 2 | 0.96 |
| 2927 | 1777C1CO1.407 | N/A | | 2 | 0.98 |
| 2928 | 1785C1CO1.142 | N/A | | 2 | 0.92 |
| 2929 | 1802C1CO1.534 | N/A | | 2 | 0.59 |
| 2930 | 1805C2CO1.439 | N/A | | 2 | 0.82 |
| 2931 | 2015C1CO1.978 | N/A | | 2 | 0.92 |
| 2932 | 2024C1CO1.166 | N/A | | 2 | 0.93 |
| 2933 | 2047C1CO1.709 | N/A | | 2 | 0.9 |
| 2934 | 2141C1CO1.572 | N/A | | 2 | 0.54 |
| 2935 | 220C1CO1.187 | N/A | | 2 | 0.62 |
| 2936 | 2216C1CO1.663 | N/A | | 2 | 0.89 |
| 2937 | 2218C1CO1.365 | N/A | | 2 | 0.64 |
| 2938 | 2241C1CO1.577 | N/A | | 2 | 1 |
| 2939 | 2536C1CO1.417 | N/A | | 2 | 0.5 |
| 2940 | 2573C1CO1.228 | N/A | | 2 | 0.67 |
| 2941 | 2593C2CO1.978 | N/A | | 2 | 0.71 |
| 2942 | 2644C1CO1.1224 | N/A | | 2 | 0.6 |
| 2943 | 2662C1CO1.154 | N/A | | 2 | 0.93 |
| 2944 | 2722C1CO1.237 | N/A | | 2 | 0.75 |
| 2945 | 2929C1CO1.283 | N/A | | 2 | 0.69 |
| 2946 | 2950C1CO1.528 | N/A | | 2 | 0.93 |
| 2947 | 299C1CO1.121 | N/A | | 2 | 0.84 |
| 2948 | 3176C2CO1.474 | N/A | | 2 | 0.67 |
| 2949 | 3218C1CO1.147 | N/A | | 2 | 0.89 |
| 2950 | 3370C1CO1.425 | N/A | | 2 | 0.86 |
| 2951 | 3542C1CO1.300 | N/A | | 2 | 0.89 |
| 2952 | 3577C2CO1.478 | N/A | | 2 | 0.94 |
| 2953 | 3585C1CO1.245 | N/A | | 2 | 0.8 |
| 2954 | 3639C1CO1.338 | N/A | | 2 | 0.9 |
| 2955 | 3756C1CO1.662 | N/A | | 2 | 0.91 |
| 2956 | 3920C1CO1.634 | N/A | | 2 | 0.72 |
| 2957 | 4151C1CO1.497 | N/A | | 2 | 0.62 |
| 2958 | 4275C1CO1.389 | N/A | | 2 | 0.83 |
| 2959 | 439C1CO1.357 | N/A | | 2 | 0.94 |
| 2960 | 4563C1CO1.291 | N/A | | 2 | 0.91 |
| 2961 | 4636C2CO1.554 | N/A | | 2 | 0.64 |
| 2962 | 4647C1CO1.284 | N/A | | 2 | 0.46 |
| 2963 | 46C1CO1.153 | N/A | | 2 | 0.67 |
| 2964 | 4713C1CO1.105 | N/A | | 2 | 0.92 |
| 2965 | 475C1CO1.1020 | N/A | | 2 | 0.98 |
| 2966 | 4867C1CO1.582 | N/A | | 2 | 0.8 |
| 2967 | 500C1CO1.578 | N/A | | 2 | 0.88 |
| 2968 | 510C2CO1.533 | N/A | | 2 | 0.96 |
| 2969 | 516C2CO1.895 | N/A | | 2 | 0.82 |
| 2970 | 521C1CO1.230 | N/A | | 2 | 0.49 |
| 2971 | 5267C1CO1.309 | N/A | | 2 | 0.93 |
| 2972 | 5358C1CO1.666 | N/A | | 2 | 0.55 |
| 2973 | 5482C1CO1.125 | N/A | | 2 | 0.83 |
| 2974 | 5559C1CO1.303 | N/A | | 2 | 0.99 |
| 2975 | 56C1CO1.88 | N/A | | 2 | 0.89 |
| 2976 | 5822C1CO1.910 | N/A | | 2 | 0.99 |
| 2977 | 6078C1CO1.647 | N/A | | 2 | 0.93 |
| 2978 | 6374C1CO1.774 | N/A | | 2 | 0.69 |
| 2979 | 6821C1CO1.448 | N/A | | 2 | 0.77 |
| 2980 | 6883C1CO1.110 | N/A | | 2 | 0.96 |

TABLE 6-continued

Identification of SEQ ID NOS. for 3,072 SNPs including 1620 validated SNPs (P = panel; V = Validated). Each SNP is located at nucleotide position 61 in the corresponding SEQ ID NO.

| SEQ ID NO | SNP_Name | New name | V | P | Score |
|---|---|---|---|---|---|
| 2981 | 693C2CO1.328 | N/A |  | 2 | 0.91 |
| 2982 | 6996C1CO1.63 | N/A |  | 2 | 0.7 |
| 2983 | 7378C1CO1.1029 | N/A |  | 2 | 0.62 |
| 2984 | 7411C1CO1.620 | N/A |  | 2 | 0.71 |
| 2985 | 7440C1CO1.559 | N/A |  | 2 | 0.54 |
| 2986 | 7944C1CO1.65 | N/A |  | 2 | 0.55 |
| 2987 | 809C2CO1.690 | N/A |  | 2 | 0.62 |
| 2988 | 8168C1CO1.470 | N/A |  | 2 | 0.88 |
| 2989 | 8176C1CO1.481 | N/A |  | 2 | 0.86 |
| 2990 | 850C1CO1.175 | N/A |  | 2 | 0.45 |
| 2991 | 8622C1CO1.330 | N/A |  | 2 | 0.74 |
| 2992 | 8623C1CO1.457 | N/A |  | 2 | 0.69 |
| 2993 | 8782C1CO1.129 | N/A |  | 2 | 0.76 |
| 2994 | 903C1CO1.499 | N/A |  | 2 | 0.7 |
| 2995 | 960C1CO1.283 | N/A |  | 2 | 0.5 |
| 2996 | 966C1CO1.483 | N/A |  | 2 | 0.97 |
| 2997 | 1754C1CO1.114 | N/A |  | 2 | 0.79 |
| 2998 | 1766C2CO1.142 | N/A |  | 2 | 0.66 |
| 2999 | 2535C1CO1.382 | N/A |  | 2 | 0.98 |
| 3000 | 2646C1CO1.1188 | N/A |  | 2 | 0.87 |
| 3001 | 2724C1CO1.751 | N/A |  | 2 | 0.92 |
| 3002 | 3030C1CO1.828 | N/A |  | 2 | 0.95 |
| 3003 | 3452C4CO1.163 | N/A |  | 2 | 0.96 |
| 3004 | 372C3CO1.122 | N/A |  | 2 | 0.87 |
| 3005 | 3768C2CO1.397 | N/A |  | 2 | 0.8 |
| 3006 | 446C1CO1.620 | N/A |  | 2 | 0.7 |
| 3007 | 513C1CO1.428 | N/A |  | 2 | 0.95 |
| 3008 | 5924C1CO1.433 | N/A |  | 2 | 0.91 |
| 3009 | 6523C1CO1.142 | N/A |  | 2 | 0.97 |
| 3010 | 6859C1CO1.525 | N/A |  | 2 | 0.89 |
| 3011 | 7335C1CO1.491 | N/A |  | 2 | 0.82 |
| 3012 | 7875C1CO1.456 | N/A |  | 2 | 0.89 |
| 3013 | 8319C1CO1.195 | N/A |  | 2 | 0.9 |
| 3014 | 834C1CO1.596 | N/A |  | 2 | 0.9 |
| 3015 | 8760C1CO1.212 | N/A |  | 2 | 0.82 |
| 3016 | 9148C1CO1.474 | N/A |  | 2 | 0.93 |
| 3017 | 1158C1CO1.154 | N/A |  | 2 | 0.9 |
| 3018 | 118C1CO1.417 | N/A |  | 2 | 0.88 |
| 3019 | 1213C1CO1.480 | N/A |  | 2 | 0.98 |
| 3020 | 1504C1CO1.463 | N/A |  | 2 | 0.97 |
| 3021 | 1712C1CO1.425 | N/A |  | 2 | 0.68 |
| 3022 | 2040C2CO1.620 | N/A |  | 2 | 0.91 |
| 3023 | 2758C1CO1.251 | N/A |  | 2 | 1 |
| 3024 | 2778C2CO1.476 | N/A |  | 2 | 0.97 |
| 3025 | 2781C3CO1.451 | N/A |  | 2 | 0.86 |
| 3026 | 33C2CO1.1119 | N/A |  | 2 | 0.98 |
| 3027 | 373C1CO1.72 | N/A |  | 2 | 0.98 |
| 3028 | 3871C1CO1.560 | N/A |  | 2 | 0.74 |
| 3029 | 3927C2CO1.806 | N/A |  | 2 | 0.76 |
| 3030 | 4206C1CO1.250 | N/A |  | 2 | 0.89 |
| 3031 | 4309C1CO1.125 | N/A |  | 2 | 0.94 |
| 3032 | 4463C2CO1.594 | N/A |  | 2 | 0.69 |
| 3033 | 4749C1CO1.85 | N/A |  | 2 | 0.93 |
| 3034 | 4810C1CO1.246 | N/A |  | 2 | 0.98 |
| 3035 | 4886C1CO1.585 | N/A |  | 2 | 0.95 |
| 3036 | 4925C1CO1.129 | N/A |  | 2 | 0.96 |
| 3037 | 5289C1CO1.203 | N/A |  | 2 | 0.74 |
| 3038 | 607C3CO1.168 | N/A |  | 2 | 0.96 |
| 3039 | 6160C1CO1.512 | N/A |  | 2 | 0.89 |
| 3040 | 672C2CO1.487 | N/A |  | 2 | 0.71 |
| 3041 | 6866C1CO1.628 | N/A |  | 2 | 0.66 |
| 3042 | 6932C1CO1.241 | N/A |  | 2 | 0.97 |
| 3043 | 6943C2CO1.80 | N/A |  | 2 | 0.92 |
| 3044 | 6953C1CO1.157 | N/A |  | 2 | 0.9 |
| 3045 | 757C1CO1.694 | N/A |  | 2 | 0.97 |
| 3046 | 809C1CO1.316 | N/A |  | 2 | 0.9 |
| 3047 | 827C1CO1.559 | N/A |  | 2 | 0.98 |
| 3048 | 850C1CO1.519 | N/A |  | 2 | 0.6 |
| 3049 | 886C1CO1.459 | N/A |  | 2 | 0.99 |
| 3050 | 9151C1CO1.237 | N/A |  | 2 | 0.82 |
| 3051 | 9225C1CO1.159 | N/A |  | 2 | 0.9 |
| 3052 | 9826C1CO1.163 | N/A |  | 2 | 0.91 |
| 3053 | all_v2.1.C5.417 | N/A |  | 2 | 0.855 |
| 3054 | all_v2.10285.C1.226 | N/A |  | 2 | 0.847 |
| 3055 | all_v2.132.C4.158 | N/A |  | 2 | 0.74 |
| 3056 | all_v2.1431.C1.739 | N/A |  | 2 | 0.738 |
| 3057 | all_v2.3533.C1.297 | N/A |  | 2 | 0.987 |
| 3058 | all_v2.2060.C2.434 | N/A |  | 2 | 0.679 |
| 3059 | all_v2.2189.C1.1126 | N/A |  | 2 | 0.987 |
| 3060 | all_v2.2351.C1.309 | N/A |  | 2 | 0.73 |
| 3061 | all_v2.2859.C1.172 | N/A |  | 2 | 0.854 |
| 3062 | all_v2.3448.C4.464 | N/A |  | 2 | 0.919 |
| 3063 | all_v2.4063.C1.644 | N/A |  | 2 | 0.908 |
| 3064 | all_v2.459.C4.508 | N/A |  | 2 | 0.837 |
| 3065 | all_v2.5160.C1.361 | N/A |  | 2 | 0.898 |
| 3066 | all_v2.5180.C1.186 | N/A |  | 2 | 0.848 |
| 3067 | all_v2.638.C1.140 | N/A |  | 2 | 0.26 |
| 3068 | all_v2.796.C2.594 | N/A |  | 2 | 0.842 |
| 3069 | 1beta501 | N/A |  | 2 | 0.308 |
| 3070 | 2beta877 | N/A |  | 2 | 0.828 |
| 3071 | 3beta51 | N/A |  | 2 | 0.756 |
| 3072 | 3beta607 | N/A |  | 2 | 0.309 |

TABLE 7

Identification of SEQ ID NOS: for Table 1 SNPs

| SEQ ID NO: | Contig SNP ID | SNP Nucleotide Position | Table 6 SNP_Name | Table 6 New Name |
|---|---|---|---|---|
| 1549 | PP_1060.c1 | 61 | 2628C1CO1.274 | cgpGmo-S401 |
| 3073 | PP_1062.c1 | 338 | | |
| 2482 | PP_1063.c1 | 61 | 204C2CO1.348 | |
| 1559 | PP_1072.C1 | 61 | 2698C1CO1.464 | cgpGmo-S409 |
| 1318 | PP_1092.C1 | 61 | 360C1CO1.520 | cgpGmo-S2273 |
| 3074 | PP_1108.C1 | 649 | | |
| 3075 | PP_1120.C1 | 514 | | |
| 2380 | PP_1159.C1 | 61 | 4715C1CO1.311 | |
| 108 | PP_1164.C1 | 61 | 95C1CO1.158 | cgpGmo-S1087a |
| 849 | PP_1206.C1 | 61 | 3350C1CO1.531 | cgpGmo-S1845 |
| 3076 | PP_127.C1 | 440 | | |
| 3077 | PP_1301.C1 | 112 | | |
| 3078 | PP_134.C1 | 709 | | |
| 3079 | PP_147.C1 | 333 | | |
| 935 | PP_1480.C3 | 61 | 4185C1CO1.502 | cgpGmo-S1923 |

TABLE 7-continued

Identification of SEQ ID NOS: for Table 1 SNPs

| SEQ ID NO: | Contig SNP ID | SNP Nucleotide Position | Table 6 SNP_Name | Table 6 New Name |
|---|---|---|---|---|
| 2643 | PP_161.C1 | 61 | 192C1CO1.309 | |
| 937 | PP_1657.C1 | 61 | 4203C1CO1.217 | cgpGmo-S1925 |
| 3080 | PTA_018.C2 | 330 | | |
| 3081 | PTA_028.c1 | 178 | | |
| 3082 | PTA_056.c1 | 594 | | |
| 3083 | PTA_079.C1 | 491 | | |
| 1493 | PTA_1090.c1 | 61 | 386C1CO1.1015 | cgpGmo-S35a |
| 2482 | PTA_1153.c1 | 61 | 204C2CO1.348 | |
| 3084 | PTA_1435.C1 | 325 | | |
| 3085 | PTA_1473.c1 | 269 | | |
| 3086 | PTA_1522.c1 | 211 | | |
| 3087 | PTA_153.c1 | 521 | | |
| 895 | PTA_1641.c1 | 61 | 3761C2CO1.570 | cgpGmo-S1887 |
| 1117 | PTA_1764.c1 | 61 | 643C1CO1.353 | cgpGmo-S2083 |
| 3088 | PTA_179.c1 | 204 | | |
| 3089 | PTA_1803.c1 | 322 | | |
| 3090 | PTA_2083.c2 | 798 | | |
| 3091 | PTA_233.C1 | 485 | | |
| 3092 | PTA_263.C1 | 666 | | |
| 760 | PTA_2675.c1 | 61 | 2399C1CO1.352 | cgpGmo-S1769 |
| 3093 | PTA_275.c2 | 165 | | |
| 691 | PTA_276.c1 | 61 | 1625C1CO1.549 | cgpGmo-S1706 |
| 1709 | PTA_286.c1 | 61 | 3552C1CO1.717 | cgpGmo-S537 |
| 3094 | PTA_423.c1 | 402 | | |
| 1549 | PTA_449.c1 | 61 | 2628C1CO1.274 | cgpGmo-S401 |
| 3095 | PTA_463.c2 | 507 | | |
| 3096 | PTA_624.C1 | 185 | | |
| 3097 | PTA_657.c2 | 314 | | |
| 1299 | PTA_685.c1 | 61 | 1554C1CO1.295 | cgpGmo-S2258 |
| 3098 | PTA_703.C2 | 308 | | |
| 3099 | PTA_854.c1 | 553 | | |
| 2556 | PTA_912.c1 | 61 | 4827C2CO1.825 | |

TABLE 8

Description of samples genotyped in Example 2

| Description | Breeding program | No. of samples | Purpose |
|---|---|---|---|
| Cape Sable, Canada | NB YC1 | 23 | Population analysis |
| Bay Bulls, Canada | NL YC2 | 23 | Population analysis |
| Georges Bank Canada | NB YC2 | 23 | Population analysis |
| Smith Sound, Canada | NL YC3 | 23 | Population analysis |
| Akureyri, Iceland | | 26 | Population analysis |
| Barents Sea, Norway | | 26 | Population analysis |
| Galway Bay, Ireland | | 15 | Population analysis |
| Family 33 | | 2 parents, 91 progeny | Segregation analysis Linkage mapping |
| Family 87 | | 2 parents, 91 progeny | Segregation analysis Linkage mapping |

TABLE 9

Analysis of types of base substitution for both predicted and validated SNPs in Example 2. Selected SNPs represent those included for testing on the two Illumina panels, validated SNPs represent those that were identified as polymorphic upon testing using samples from four Canadian populations.

| Base Substitution | Selected SNPs | Validated Polymorphic SNPs |
|---|---|---|
| A/G | 853 | 430 |
| C/T | 807 | 422 |
| A/C | 397 | 211 |
| A/T | 416 | 241 |
| C/G | 211 | 100 |
| G/T | 388 | 216 |
| Total | 3072 | 1620 |

TABLE 10

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 1 | cgpGmo-S1438 | CGPIA1 | 0 |
| 2 | cgpGmo-S78 | CGPIA1 | 4.058 |
| 3 | cgpGmo-S564 | CGPIA1 | 4.488 |
| 4 | cgpGmo-S105 | CGPIA1 | 5.038 |
| 5 | cgpGmo-S940 | CGPIA1 | 5.998 |
| 6 | cgpGmo-S2254 | CGPIA1 | 6.019 |
| 7 | cgpGmo-S512 | CGPIA1 | 6.93 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 8 | cgpGmo-S1471 | CGPIA1 | 6.959 |
| 9 | cgpGmo-S35a | CGPIA1 | 7.229 |
| 10 | cgpGmo-S1393b | CGPIA1 | 7.305 |
| 11 | cgpGmo-S1426 | CGPIA1 | 7.437 |
| 12 | cgpGmo-S1823 | CGPIA1 | 7.608 |
| 13 | cgpGmo-S1666 | CGPIA1 | 7.823 |
| 14 | cgpGmo-S387a | CGPIA1 | 8.005 |
| 15 | cgpGmo-S2068 | CGPIA1 | 8.277 |
| 16 | cgpGmo-S1840 | CGPIA1 | 8.733 |
| 17 | cgpGmo-S1393a | CGPIA1 | 8.924 |
| 18 | cgpGmo-S1239 | CGPIA1 | 9.383 |
| 19 | cgpGmo-S1369 | CGPIA1 | 9.674 |
| 20 | cgpGmo-S1954 | CGPIA1 | 9.993 |
| 21 | cgpGmo-S1817 | CGPIA1 | 10.78 |
| 22 | cgpGmo-S1336 | CGPIA1 | 10.956 |
| 23 | cgpGmo-S686a | CGPIA1 | 12.899 |
| 24 | cgpGmo-S686b | CGPIA1 | 12.899 |
| 25 | cgpGmo-S896 | CGPIA1 | 13.208 |
| 26 | cgpGmo-S807 | CGPIA1 | 13.736 |
| 27 | cgpGmo-S1407 | CGPIA1 | 14.055 |
| 28 | cgpGmo-S1788 | CGPIA1 | 14.333 |
| 29 | cgpGmo-S1181 | CGPIA1 | 15.316 |
| 30 | cgpGmo-S1167 | CGPIA1 | 15.522 |
| 31 | cgpGmo-S334 | CGPIA1 | 15.765 |
| 32 | cgpGmo-S787 | CGPIA1 | 15.765 |
| 33 | cgpGmo-S968 | CGPIA1 | 16.064 |
| 34 | cgpGmo-S283 | CGPIA1 | 16.181 |
| 35 | cgpGmo-S760 | CGPIA1 | 16.214 |
| 36 | cgpGmo-S844 | CGPIA1 | 16.887 |
| 37 | cgpGmo-S985 | CGPIA1 | 18.262 |
| 38 | cgpGmo-S270 | CGPIA1 | 18.309 |
| 39 | cgpGmo-S1703 | CGPIA1 | 18.604 |
| 40 | cgpGmo-S1196b | CGPIA1 | 18.717 |
| 41 | cgpGmo-S694 | CGPIA1 | 18.922 |
| 42 | cgpGmo-S875b | CGPIA1 | 20.514 |
| 43 | cgpGmo-S876 | CGPIA1 | 20.514 |
| 44 | cgpGmo-S1268 | CGPIA1 | 21.625 |
| 45 | cgpGmo-S1842 | CGPIA1 | 22.295 |
| 46 | cgpGmo-S2021 | CGPIA1 | 23.377 |
| 47 | cgpGmo-S1806 | CGPIA1 | 24.287 |
| 48 | cgpGmo-S1365a | CGPIA1 | 24.338 |
| 49 | cgpGmo-S291 | CGPIA1 | 27.737 |
| 50 | cgpGmo-S1579 | CGPIA1 | 27.89 |
| 51 | cgpGmo-S773 | CGPIA1 | 30.113 |
| 52 | cgpGmo-S83 | CGPIA1 | 31.123 |
| 53 | cgpGmo-S605 | CGPIA1 | 31.415 |
| 54 | cgpGmo-S852 | CGPIA1 | 31.565 |
| 55 | cgpGmo-S536 | CGPIA1 | 32.29 |
| 56 | cgpGmo-S1107 | CGPIA1 | 33.521 |
| 57 | cgpGmo-S1749 | CGPIA1 | 34.985 |
| 58 | cgpGmo-S523 | CGPIA1 | 36.323 |
| 59 | cgpGmo-S254 | CGPIA1 | 37.486 |
| 60 | cgpGmo-S1801 | CGPIA1 | 37.986 |
| 61 | cgpGmo-S1982 | CGPIA1 | 38.189 |
| 62 | cgpGmo-S1683 | CGPIA1 | 38.807 |
| 63 | cgpGmo-S2082 | CGPIA1 | 38.807 |
| 64 | cgpGmo-S339 | CGPIA1 | 40.613 |
| 65 | cgpGmo-S603 | CGPIA1 | 40.619 |
| 66 | cgpGmo-S1038 | CGPIA1 | 41.568 |
| 67 | cgpGmo-S360 | CGPIA1 | 41.58 |
| 68 | cgpGmo-S828 | CGPIA1 | 42.165 |
| 69 | cgpGmo-S1845 | CGPIA1 | 43.054 |
| 70 | cgpGmo-S2025 | CGPIA1 | 43.612 |
| 71 | cgpGmo-S1224 | CGPIA1 | 44.261 |
| 72 | cgpGmo-S292b | CGPIA1 | 44.914 |
| 73 | cgpGmo-S1969 | CGPIA1 | 45.138 |
| 74 | cgpGmo-S407 | CGPIA1 | 46.095 |
| 75 | cgpGmo-S1087b | CGPIA1 | 51.659 |
| 76 | cgpGmo-S1212 | CGPIA1 | 57.927 |
| 77 | cgpGmo-S868 | CGPIA2 | 0 |
| 78 | cgpGmo-S749a | CGPIA2 | 0.117 |
| 79 | cgpGmo-S754 | CGPIA2 | 0.235 |
| 80 | cgpGmo-S749b | CGPIA2 | 1.434 |
| 81 | cgpGmo-S1338 | CGPIA2 | 1.788 |
| 82 | cgpGmo-S305 | CGPIA2 | 3.426 |
| 83 | cgpGmo-S1274 | CGPIA2 | 3.818 |
| 84 | cgpGmo-S2070 | CGPIA2 | 4.704 |
| 85 | cgpGmo-S535b | CGPIA2 | 5.012 |
| 86 | cgpGmo-S1662 | CGPIA2 | 5.563 |
| 87 | cgpGmo-S535a | CGPIA2 | 7.002 |
| 88 | cgpGmo-S1163 | CGPIA2 | 7.376 |
| 89 | cgpGmo-S2157 | CGPIA2 | 7.898 |
| 90 | cgpGmo-S604 | CGPIA2 | 9.164 |
| 91 | cgpGmo-S1235 | CGPIA2 | 9.496 |
| 92 | cgpGmo-S2264 | CGPIA2 | 9.734 |
| 93 | cgpGmo-S2052 | CGPIA2 | 10.53 |
| 94 | cgpGmo-S1677 | CGPIA2 | 11.013 |
| 95 | cgpGmo-S1879 | CGPIA2 | 11.813 |
| 96 | cgpGmo-S1997 | CGPIA2 | 12.1 |
| 97 | cgpGmo-S1999 | CGPIA2 | 12.949 |
| 98 | cgpGmo-S16a | CGPIA2 | 13.288 |
| 99 | cgpGmo-S1563c | CGPIA2 | 13.368 |
| 100 | cgpGmo-S1910 | CGPIA2 | 13.762 |
| 101 | cgpGmo-S1743 | CGPIA2 | 13.889 |
| 102 | cgpGmo-S1916 | CGPIA2 | 13.889 |
| 103 | cgpGmo-S951b | CGPIA2 | 14.387 |
| 104 | cgpGmo-S77 | CGPIA2 | 15.022 |
| 105 | cgpGmo-S338b | CGPIA2 | 15.676 |
| 106 | cgpGmo-S946 | CGPIA2 | 15.915 |
| 107 | cgpGmo-S185 | CGPIA2 | 16.245 |
| 108 | cgpGmo-S155 | CGPIA2 | 16.543 |
| 109 | cgpGmo-S1047 | CGPIA2 | 16.881 |
| 110 | cgpGmo-S1825 | CGPIA2 | 20.029 |
| 111 | cgpGmo-S590 | CGPIA2 | 22.045 |
| 112 | cgpGmo-S1230a | CGPIA2 | 24.762 |
| 113 | cgpGmo-S1620 | CGPIA2 | 26.063 |
| 114 | cgpGmo-S728 | CGPIA2 | 29.603 |
| 115 | cgpGmo-S1221a | CGPIA2 | 32.8 |
| 116 | cgpGmo-S1113 | CGPIA2 | 36.469 |
| 117 | cgpGmo-S1112 | CGPIA2 | 36.469 |
| 118 | cgpGmo-S1693 | CGPIA2 | 37.571 |
| 119 | cgpGmo-S1111 | CGPIA2 | 38.88 |
| 120 | cgpGmo-S2266 | CGPIA2 | 39.88 |
| 121 | cgpGmo-S40 | CGPIA2 | 40.497 |
| 122 | cgpGmo-S318 | CGPIA2 | 42.248 |
| 123 | cgpGmo-S1231 | CGPIA2 | 43.533 |
| 124 | cgpGmo-S810 | CGPIA2 | 44.84 |
| 125 | cgpGmo-S1354 | CGPIA2 | 45.026 |
| 126 | cgpGmo-S400 | CGPIA2 | 47.431 |
| 127 | cgpGmo-S2001 | CGPIA2 | 48.601 |
| 128 | cgpGmo-S1216a | CGPIA2 | 49.675 |
| 129 | cgpGmo-S1522 | CGPIA2 | 49.683 |
| 130 | cgpGmo-S333 | CGPIA2 | 49.931 |
| 131 | cgpGmo-S1284 | CGPIA2 | 50.473 |
| 132 | cgpGmo-S1217 | CGPIA2 | 51.137 |
| 133 | cgpGmo-S1216b | CGPIA2 | 51.359 |
| 134 | cgpGmo-S548 | CGPIA2 | 51.486 |
| 135 | cgpGmo-S68 | CGPIA2 | 55.472 |
| 136 | cgpGmo-S973 | CGPIA2 | 56.189 |
| 137 | cgpGmo-S1908 | CGPIA2 | 56.22 |
| 138 | cgpGmo-S2112 | CGPIA2 | 56.256 |
| 139 | cgpGmo-S1026 | CGPIA2 | 56.661 |
| 140 | cgpGmo-S1205 | CGPIA2 | 56.739 |
| 141 | cgpGmo-S454 | CGPIA2 | 56.78 |
| 142 | cgpGmo-S532 | CGPIA2 | 56.835 |
| 143 | cgpGmo-S1068 | CGPIA2 | 56.835 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr  | Locus        | Group  | Position |
|-----|--------------|--------|----------|
| 144 | cgpGmo-S1101a | CGPIA2 | 56.835   |
| 145 | cgpGmo-S1456 | CGPIA2 | 56.835   |
| 146 | cgpGmo-S1022 | CGPIA2 | 57.035   |
| 147 | cgpGmo-S174  | CGPIA2 | 57.04    |
| 148 | cgpGmo-S184  | CGPIA2 | 57.04    |
| 149 | cgpGmo-S1751 | CGPIA2 | 57.296   |
| 150 | cgpGmo-S1907 | CGPIA2 | 57.574   |
| 151 | cgpGmo-S182  | CGPIA2 | 57.574   |
| 152 | cgpGmo-S2146 | CGPIA2 | 58.037   |
| 153 | cgpGmo-S489  | CGPIA2 | 58.44    |
| 154 | cgpGmo-S780  | CGPIA2 | 60.286   |
| 155 | cgpGmo-S444  | CGPIA3 | 0        |
| 156 | cgpGmo-S1652 | CGPIA3 | 6.237    |
| 157 | cgpGmo-S81   | CGPIA3 | 7.433    |
| 158 | cgpGmo-S514  | CGPIA3 | 9.709    |
| 159 | cgpGmo-S1296 | CGPIA3 | 10.053   |
| 160 | cgpGmo-S666  | CGPIA3 | 11.139   |
| 161 | cgpGmo-S466  | CGPIA3 | 11.95    |
| 162 | cgpGmo-S32   | CGPIA3 | 12.509   |
| 163 | cgpGmo-S2229 | CGPIA3 | 12.929   |
| 164 | cgpGmo-S1070 | CGPIA3 | 13.059   |
| 165 | cgpGmo-S2185 | CGPIA3 | 13.974   |
| 166 | cgpGmo-S646  | CGPIA3 | 16.28    |
| 167 | cgpGmo-S1808 | CGPIA3 | 18.827   |
| 168 | cgpGmo-S453  | CGPIA3 | 19.415   |
| 169 | cgpGmo-S526  | CGPIA3 | 23.411   |
| 170 | cgpGmo-S171  | CGPIA3 | 23.435   |
| 171 | cgpGmo-S491  | CGPIA3 | 23.741   |
| 172 | cgpGmo-S872a | CGPIA3 | 24.459   |
| 173 | cgpGmo-S172  | CGPIA3 | 24.893   |
| 174 | cgpGmo-S1504 | CGPIA3 | 26.797   |
| 175 | cgpGmo-S872b | CGPIA3 | 26.938   |
| 176 | cgpGmo-S199  | CGPIA3 | 27.464   |
| 177 | cgpGmo-S1007 | CGPIA3 | 27.464   |
| 178 | cgpGmo-S408  | CGPIA3 | 27.714   |
| 179 | cgpGmo-S301  | CGPIA3 | 28.939   |
| 180 | cgpGmo-S2049 | CGPIA3 | 29.346   |
| 181 | cgpGmo-S923  | CGPIA3 | 29.543   |
| 182 | cgpGmo-S769  | CGPIA3 | 29.564   |
| 183 | cgpGmo-S1757 | CGPIA3 | 31.246   |
| 184 | cgpGmo-S1263 | CGPIA3 | 31.342   |
| 185 | cgpGmo-S716  | CGPIA3 | 32.884   |
| 186 | cgpGmo-S689  | CGPIA3 | 33.765   |
| 187 | cgpGmo-S643b | CGPIA3 | 35.835   |
| 188 | cgpGmo-S398  | CGPIA3 | 37.675   |
| 189 | cgpGmo-S755  | CGPIA3 | 39.034   |
| 190 | cgpGmo-S1927 | CGPIA3 | 39.187   |
| 191 | cgpGmo-S478  | CGPIA3 | 41.41    |
| 192 | cgpGmo-S643a | CGPIA3 | 41.734   |
| 193 | cgpGmo-S1789 | CGPIA3 | 41.845   |
| 194 | cgpGmo-S759  | CGPIA3 | 42.416   |
| 195 | cgpGmo-S718a | CGPIA3 | 43.345   |
| 196 | cgpGmo-S801  | CGPIA3 | 43.345   |
| 197 | cgpGmo-S1469 | CGPIA3 | 43.644   |
| 198 | cgpGmo-S718b | CGPIA3 | 43.656   |
| 199 | cgpGmo-S1598b | CGPIA3 | 45.42   |
| 200 | cgpGmo-S377  | CGPIA3 | 46.202   |
| 201 | cgpGmo-S22b  | CGPIA3 | 47.762   |
| 202 | cgpGmo-S1967 | CGPIA3 | 48.597   |
| 203 | cgpGmo-S771  | CGPIA3 | 49.41    |
| 204 | cgpGmo-S1656 | CGPIA3 | 51.471   |
| 205 | cgpGmo-S1131 | CGPIA3 | 52.512   |
| 206 | cgpGmo-S223  | CGPIA3 | 52.915   |
| 207 | cgpGmo-S1978 | CGPIA3 | 54.812   |
| 208 | cgpGmo-S644  | CGPIA3 | 55.382   |
| 209 | cgpGmo-S1328 | CGPIA3 | 56.35    |
| 210 | cgpGmo-S1218 | CGPIA3 | 56.601   |
| 211 | cgpGmo-S1890 | CGPIA3 | 57.246   |
| 212 | cgpGmo-S2255 | CGPIA3 | 57.284   |
| 213 | cgpGmo-S99   | CGPIA3 | 60.85    |
| 214 | cgpGmo-S799  | CGPIA3 | 61.887   |
| 215 | cgpGmo-S734  | CGPIA3 | 62.921   |
| 216 | cgpGmo-S1984 | CGPIA4 | 0        |
| 217 | cgpGmo-S204  | CGPIA4 | 1.475    |
| 218 | cgpGmo-S552  | CGPIA4 | 1.754    |
| 219 | cgpGmo-S1739 | CGPIA4 | 3.262    |
| 220 | cgpGmo-S1730 | CGPIA4 | 3.314    |
| 221 | cgpGmo-S657a | CGPIA4 | 4.099    |
| 222 | cgpGmo-S2155 | CGPIA4 | 6.468    |
| 223 | cgpGmo-S2156 | CGPIA4 | 6.468    |
| 224 | cgpGmo-S1491b | CGPIA4 | 7.914   |
| 225 | cgpGmo-S1491a | CGPIA4 | 9.37    |
| 226 | cgpGmo-S1197a | CGPIA4 | 10.894  |
| 227 | cgpGmo-S126a | CGPIA4 | 11.728   |
| 228 | cgpGmo-S1091 | CGPIA4 | 13.252   |
| 229 | cgpGmo-S1833 | CGPIA4 | 13.811   |
| 230 | cgpGmo-S126b | CGPIA4 | 15.458   |
| 231 | cgpGmo-S837  | CGPIA4 | 15.809   |
| 232 | cgpGmo-S395  | CGPIA4 | 17.036   |
| 233 | cgpGmo-S267  | CGPIA4 | 17.615   |
| 234 | cgpGmo-S1445 | CGPIA4 | 19.063   |
| 235 | cgpGmo-S1079 | CGPIA4 | 22.07    |
| 236 | cgpGmo-S1841 | CGPIA4 | 24.678   |
| 237 | cgpGmo-S2279 | CGPIA4 | 25.633   |
| 238 | cgpGmo-S1360a | CGPIA4 | 25.693  |
| 239 | cgpGmo-S791  | CGPIA4 | 25.693   |
| 240 | cgpGmo-S1360b | CGPIA4 | 26.136  |
| 241 | 5279C2CO1.498 | CGPIA4 | 26.322  |
| 242 | cgpGmo-S819b | CGPIA4 | 26.979   |
| 243 | cgpGmo-S250  | CGPIA4 | 26.992   |
| 244 | cgpGmo-S1979 | CGPIA4 | 28.626   |
| 245 | cgpGmo-S2056 | CGPIA4 | 29.8     |
| 246 | cgpGmo-S792  | CGPIA4 | 30.051   |
| 247 | cgpGmo-S205  | CGPIA4 | 31.162   |
| 248 | cgpGmo-S434b | CGPIA4 | 32.113   |
| 249 | cgpGmo-S434a | CGPIA4 | 32.16    |
| 250 | cgpGmo-S1865 | CGPIA4 | 33.942   |
| 251 | cgpGmo-S850  | CGPIA4 | 34.174   |
| 252 | cgpGmo-S1558 | CGPIA4 | 34.408   |
| 253 | cgpGmo-S1768 | CGPIA4 | 34.661   |
| 254 | cgpGmo-S2079 | CGPIA4 | 34.876   |
| 255 | cgpGmo-S701  | CGPIA4 | 35.114   |
| 256 | cgpGmo-S720  | CGPIA4 | 35.663   |
| 257 | cgpGmo-S306a | CGPIA4 | 35.748   |
| 258 | cgpGmo-S1010 | CGPIA4 | 35.985   |
| 259 | cgpGmo-S306b | CGPIA4 | 36.057   |
| 260 | cgpGmo-S93   | CGPIA4 | 36.846   |
| 261 | cgpGmo-S354  | CGPIA4 | 37.098   |
| 262 | cgpGmo-S615  | CGPIA4 | 37.125   |
| 263 | cgpGmo-S543  | CGPIA4 | 37.616   |
| 264 | cgpGmo-S420  | CGPIA4 | 37.616   |
| 265 | cgpGmo-S1301 | CGPIA4 | 37.866   |
| 266 | cgpGmo-S818a | CGPIA4 | 37.972   |
| 267 | cgpGmo-S1856 | CGPIA4 | 38.872   |
| 268 | cgpGmo-S134  | CGPIA4 | 39.317   |
| 269 | cgpGmo-S1744 | CGPIA4 | 39.468   |
| 270 | cgpGmo-S2015 | CGPIA4 | 39.916   |
| 271 | cgpGmo-S167  | CGPIA4 | 45.729   |
| 272 | cgpGmo-S1698 | CGPIA4 | 59.88    |
| 273 | cgpGmo-S2132 | CGPIA4 | 70.722   |
| 274 | cgpGmo-S938  | CGPIA5 | 0        |
| 275 | cgpGmo-S2044 | CGPIA5 | 0.872    |
| 276 | cgpGmo-S937  | CGPIA5 | 1.675    |
| 277 | cgpGmo-S58b  | CGPIA5 | 2.844    |
| 278 | cgpGmo-S129  | CGPIA5 | 3.287    |
| 279 | cgpGmo-S2136 | CGPIA5 | 3.409    |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 280 | cgpGmo-S2115 | CGPIA5 | 3.57 |
| 281 | cgpGmo-S1745 | CGPIA5 | 4.848 |
| 282 | cgpGmo-S1162 | CGPIA5 | 4.865 |
| 283 | cgpGmo-S1241 | CGPIA5 | 5.046 |
| 284 | cgpGmo-S496 | CGPIA5 | 6.768 |
| 285 | cgpGmo-S1924 | CGPIA5 | 7.038 |
| 286 | cgpGmo-S2235 | CGPIA5 | 9.6 |
| 287 | cgpGmo-S894 | CGPIA5 | 10.205 |
| 288 | cgpGmo-S2042 | CGPIA5 | 11.241 |
| 289 | cgpGmo-S990 | CGPIA5 | 11.923 |
| 290 | cgpGmo-S2069 | CGPIA5 | 12.113 |
| 291 | cgpGmo-S2196 | CGPIA5 | 12.122 |
| 292 | cgpGmo-S1771 | CGPIA5 | 12.288 |
| 293 | cgpGmo-S991a | CGPIA5 | 12.726 |
| 294 | cgpGmo-S228 | CGPIA5 | 13.115 |
| 295 | cgpGmo-S2083 | CGPIA5 | 13.39 |
| 296 | cgpGmo-S1169 | CGPIA5 | 13.392 |
| 297 | cgpGmo-S310 | CGPIA5 | 13.394 |
| 298 | cgpGmo-S162 | CGPIA5 | 14.023 |
| 299 | cgpGmo-S991b | CGPIA5 | 14.227 |
| 300 | cgpGmo-S1232 | CGPIA5 | 16 |
| 301 | cgpGmo-S977 | CGPIA5 | 26.336 |
| 302 | cgpGmo-S239a | CGPIA5 | 26.336 |
| 303 | cgpGmo-S1519 | CGPIA5 | 29.305 |
| 304 | cgpGmo-S1634 | CGPIA5 | 29.382 |
| 305 | cgpGmo-S1588b | CGPIA5 | 29.919 |
| 306 | cgpGmo-S1588a | CGPIA5 | 30.015 |
| 307 | cgpGmo-S1787 | CGPIA5 | 30.546 |
| 308 | cgpGmo-S893 | CGPIA5 | 30.665 |
| 309 | cgpGmo-S640b | CGPIA5 | 30.741 |
| 310 | cgpGmo-S137 | CGPIA5 | 31.141 |
| 311 | cgpGmo-S82 | CGPIA5 | 31.141 |
| 312 | GP_2_3 | CGPIA5 | 31.778 |
| 313 | GP_2_1 | CGPIA5 | 31.778 |
| 314 | cgpGmo-S715 | CGPIA5 | 33.509 |
| 315 | cgpGmo-S239b | CGPIA5 | 34.351 |
| 316 | cgpGmo-S1942 | CGPIA5 | 35.493 |
| 317 | cgpGmo-S774 | CGPIA5 | 37.607 |
| 318 | cgpGmo-S61 | CGPIA5 | 37.992 |
| 319 | cgpGmo-S2189 | CGPIA5 | 38.06 |
| 320 | cgpGmo-S1158 | CGPIA5 | 38.533 |
| 321 | cgpGmo-S2111 | CGPIA5 | 39.324 |
| 322 | cgpGmo-S2123 | CGPIA5 | 39.769 |
| 323 | cgpGmo-S2087 | CGPIA5 | 40.073 |
| 324 | cgpGmo-S158b | CGPIA5 | 40.244 |
| 325 | cgpGmo-S1816 | CGPIA5 | 40.666 |
| 326 | cgpGmo-S158a | CGPIA5 | 40.75 |
| 327 | cgpGmo-S1607 | CGPIA5 | 41.075 |
| 328 | cgpGmo-S1672 | CGPIA5 | 41.927 |
| 329 | cgpGmo-S1985 | CGPIA5 | 45.067 |
| 330 | cgpGmo-S725 | CGPIA5 | 49.237 |
| 331 | cgpGmo-S404a | CGPIA5 | 51.757 |
| 332 | cgpGmo-S1452 | CGPIA5 | 51.801 |
| 333 | cgpGmo-S1902 | CGPIA5 | 52.335 |
| 334 | cgpGmo-S1540 | CGPIA5 | 52.52 |
| 335 | cgpGmo-S1078 | CGPIA5 | 52.626 |
| 336 | cgpGmo-S800 | CGPIA5 | 53.602 |
| 337 | cgpGmo-S122 | CGPIA5 | 54.637 |
| 338 | cgpGmo-S1993 | CGPIA6 | −2.956 |
| 339 | cgpGmo-S1538b | CGPIA6 | −2.257 |
| 340 | cgpGmo-S347 | CGPIA6 | 0 |
| 341 | cgpGmo-S1359 | CGPIA6 | 0.612 |
| 342 | cgpGmo-S119b | CGPIA6 | 1.143 |
| 343 | cgpGmo-S119a | CGPIA6 | 1.484 |
| 344 | cgpGmo-S2165 | CGPIA6 | 3.206 |
| 345 | cgpGmo-S848 | CGPIA6 | 3.382 |
| 346 | cgpGmo-S2172 | CGPIA6 | 4.153 |
| 347 | cgpGmo-S1473 | CGPIA6 | 6.957 |
| 348 | cgpGmo-S1538a | CGPIA6 | 10.524 |
| 349 | cgpGmo-S2154 | CGPIA6 | 13.687 |
| 350 | cgpGmo-S1258a | CGPIA6 | 14.915 |
| 351 | cgpGmo-S764 | CGPIA6 | 16.651 |
| 352 | cgpGmo-S88b | CGPIA6 | 17.003 |
| 353 | cgpGmo-S1258b | CGPIA6 | 17.86 |
| 354 | cgpGmo-S530a | CGPIA6 | 21.781 |
| 355 | cgpGmo-S1887 | CGPIA6 | 24.875 |
| 356 | cgpGmo-S1086 | CGPIA6 | 29.114 |
| 357 | cgpGmo-S1510 | CGPIA6 | 30.62 |
| 358 | cgpGmo-S1252 | CGPIA6 | 31.23 |
| 359 | cgpGmo-S1256b | CGPIA6 | 32.691 |
| 360 | cgpGmo-S1256a | CGPIA6 | 32.693 |
| 361 | cgpGmo-S1332 | CGPIA6 | 33.153 |
| 362 | cgpGmo-S2065 | CGPIA6 | 33.34 |
| 363 | cgpGmo-S2200 | CGPIA6 | 33.353 |
| 364 | cgpGmo-S1062 | CGPIA6 | 33.67 |
| 365 | cgpGmo-S365b | CGPIA6 | 33.755 |
| 366 | cgpGmo-S389 | CGPIA6 | 33.755 |
| 367 | cgpGmo-S628 | CGPIA6 | 34.105 |
| 368 | cgpGmo-S321 | CGPIA6 | 34.105 |
| 369 | cgpGmo-S1940 | CGPIA6 | 34.166 |
| 370 | cgpGmo-S714a | CGPIA6 | 34.222 |
| 371 | cgpGmo-S630 | CGPIA6 | 34.478 |
| 372 | cgpGmo-S2124 | CGPIA6 | 34.484 |
| 373 | cgpGmo-S2081 | CGPIA6 | 35.4 |
| 374 | cgpGmo-S537 | CGPIA6 | 35.697 |
| 375 | cgpGmo-S203 | CGPIA6 | 36.426 |
| 376 | cgpGmo-S930 | CGPIA6 | 37.787 |
| 377 | cgpGmo-S785b | CGPIA6 | 37.787 |
| 378 | cgpGmo-S1872 | CGPIA6 | 37.858 |
| 379 | cgpGmo-S470 | CGPIA6 | 38.885 |
| 380 | cgpGmo-S60 | CGPIA6 | 40.601 |
| 381 | cgpGmo-S72 | CGPIA6 | 40.617 |
| 382 | cgpGmo-S1075 | CGPIA6 | 40.617 |
| 383 | cgpGmo-S2207 | CGPIA6 | 40.869 |
| 384 | cgpGmo-S312 | CGPIA6 | 41.914 |
| 385 | cgpGmo-S768 | CGPIA6 | 42.051 |
| 386 | cgpGmo-S277 | CGPIA6 | 42.989 |
| 387 | cgpGmo-S1687 | CGPIA6 | 44.596 |
| 388 | cgpGmo-S672 | CGPIA6 | 45.18 |
| 389 | cgpGmo-S1629 | CGPIA6 | 45.77 |
| 390 | cgpGmo-S2176 | CGPIA6 | 45.77 |
| 391 | cgpGmo-S638a | CGPIA6 | 47.169 |
| 392 | cgpGmo-S1813 | CGPIA6 | 47.169 |
| 393 | cgpGmo-S1777 | CGPIA6 | 48.924 |
| 394 | cgpGmo-S173 | CGPIA6 | 49.927 |
| 395 | cgpGmo-S121 | CGPIA6 | 50.726 |
| 396 | cgpGmo-S1721 | CGPIA6 | 50.863 |
| 397 | cgpGmo-S638b | CGPIA6 | 50.895 |
| 398 | cgpGmo-S212 | CGPIA6 | 52.168 |
| 399 | cgpGmo-S1463b | CGPIA6 | 52.985 |
| 400 | cgpGmo-S1826 | CGPIA6 | 55.268 |
| 401 | cgpGmo-S2119 | CGPIA6 | 60.953 |
| 402 | cgpGmo-S2100 | CGPIA7 | 0 |
| 403 | cgpGmo-S26 | CGPIA7 | 1.823 |
| 404 | cgpGmo-S1935 | CGPIA7 | 3.476 |
| 405 | cgpGmo-S1763 | CGPIA7 | 4.153 |
| 406 | cgpGmo-S393 | CGPIA7 | 4.557 |
| 407 | cgpGmo-S1906 | CGPIA7 | 4.572 |
| 408 | Pgrmc_1_1 | CGPIA7 | 4.619 |
| 409 | cgpGmo-S282 | CGPIA7 | 4.62 |
| 410 | cgpGmo-S255 | CGPIA7 | 4.793 |
| 411 | cgpGmo-S976b | CGPIA7 | 5.643 |
| 412 | cgpGmo-S833 | CGPIA7 | 5.704 |
| 413 | cgpGmo-S895 | CGPIA7 | 5.864 |
| 414 | cgpGmo-S1692 | CGPIA7 | 5.947 |
| 415 | cgpGmo-S834 | CGPIA7 | 6.228 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 416 | cgpGmo-S1867 | CGPIA7 | 6.436 |
| 417 | cgpGmo-S1399b | CGPIA7 | 6.455 |
| 418 | cgpGmo-S1859 | CGPIA7 | 6.724 |
| 419 | cgpGmo-S1497 | CGPIA7 | 7.43 |
| 420 | cgpGmo-S674 | CGPIA7 | 7.46 |
| 421 | cgpGmo-S1399a | CGPIA7 | 8.142 |
| 422 | cgpGmo-S1279 | CGPIA7 | 8.168 |
| 423 | cgpGmo-S1200 | CGPIA7 | 9.272 |
| 424 | cgpGmo-S877 | CGPIA7 | 10.283 |
| 425 | cgpGmo-S741 | CGPIA7 | 15.235 |
| 426 | cgpGmo-S2277 | CGPIA7 | 16.154 |
| 427 | cgpGmo-S2019 | CGPIA7 | 17.391 |
| 428 | cgpGmo-S917 | CGPIA7 | 18.267 |
| 429 | cgpGmo-S268 | CGPIA7 | 19.147 |
| 430 | cgpGmo-S1183 | CGPIA7 | 19.147 |
| 431 | cgpGmo-S1991 | CGPIA7 | 19.147 |
| 432 | cgpGmo-S2158 | CGPIA7 | 19.147 |
| 433 | cgpGmo-S1039b | CGPIA7 | 19.147 |
| 434 | cgpGmo-S1830 | CGPIA7 | 19.147 |
| 435 | cgpGmo-S157 | CGPIA7 | 19.147 |
| 436 | cgpGmo-S870 | CGPIA7 | 19.147 |
| 437 | cgpGmo-S982a | CGPIA7 | 19.147 |
| 438 | cgpGmo-S419 | CGPIA7 | 19.147 |
| 439 | cgpGmo-S352 | CGPIA7 | 19.147 |
| 440 | cgpGmo-S920 | CGPIA7 | 19.147 |
| 441 | cgpGmo-S152 | CGPIA7 | 19.147 |
| 442 | cgpGmo-S1089 | CGPIA7 | 19.147 |
| 443 | cgpGmo-S183 | CGPIA7 | 19.147 |
| 444 | cgpGmo-S1039a | CGPIA7 | 19.147 |
| 445 | cgpGmo-S814a | CGPIA7 | 19.147 |
| 446 | cgpGmo-S1425 | CGPIA7 | 19.147 |
| 447 | cgpGmo-S673 | CGPIA7 | 19.147 |
| 448 | cgpGmo-S1810 | CGPIA7 | 19.147 |
| 449 | cgpGmo-S739 | CGPIA7 | 19.147 |
| 450 | cgpGmo-S260a | CGPIA7 | 20.06 |
| 451 | cgpGmo-S426 | CGPIA7 | 20.392 |
| 452 | cgpGmo-S1644 | CGPIA7 | 22.341 |
| 453 | cgpGmo-S1065 | CGPIA7 | 24.377 |
| 454 | cgpGmo-S207 | CGPIA7 | 26.97 |
| 455 | cgpGmo-S62 | CGPIA7 | 27.261 |
| 456 | cgpGmo-S244 | CGPIA7 | 27.975 |
| 457 | cgpGmo-S209 | CGPIA7 | 28.015 |
| 458 | cgpGmo-S669 | CGPIA7 | 28.342 |
| 459 | cgpGmo-S889b | CGPIA7 | 28.361 |
| 460 | cgpGmo-S992 | CGPIA7 | 28.64 |
| 461 | cgpGmo-S63 | CGPIA7 | 28.791 |
| 462 | cgpGmo-S2026 | CGPIA7 | 28.837 |
| 463 | cgpGmo-S1668 | CGPIA7 | 29.63 |
| 464 | cgpGmo-S869 | CGPIA7 | 32.242 |
| 465 | cgpGmo-S2202 | CGPIA7 | 32.307 |
| 466 | cgpGmo-S1858 | CGPIA7 | 34.979 |
| 467 | cgpGmo-S584 | CGPIA7 | 34.991 |
| 468 | cgpGmo-S422 | CGPIA7 | 35 |
| 469 | cgpGmo-S831 | CGPIA7 | 35.583 |
| 470 | cgpGmo-S385a | CGPIA7 | 38.005 |
| 471 | cgpGmo-S189 | CGPIA7 | 38.23 |
| 472 | cgpGmo-S830 | CGPIA7 | 38.685 |
| 473 | cgpGmo-S2193 | CGPIA7 | 38.877 |
| 474 | cgpGmo-S1058 | CGPIA7 | 39.066 |
| 475 | cgpGmo-S110 | CGPIA7 | 40.658 |
| 476 | cgpGmo-S999 | CGPIA7 | 40.658 |
| 477 | cgpGmo-S1782 | CGPIA7 | 41.095 |
| 478 | cgpGmo-S2134 | CGPIA7 | 42.716 |
| 479 | cgpGmo-S452 | CGPIA7 | 44.739 |
| 480 | cgpGmo-S595 | CGPIA8 | 0 |
| 481 | cgpGmo-S1358 | CGPIA8 | 0.031 |
| 482 | cgpGmo-S1050 | CGPIA8 | 0.551 |
| 483 | cgpGmo-S1030 | CGPIA8 | 2.041 |
| 484 | cgpGmo-S232b | CGPIA8 | 3.145 |
| 485 | cgpGmo-S232a | CGPIA8 | 4.257 |
| 486 | cgpGmo-S52 | CGPIA8 | 5.173 |
| 487 | cgpGmo-S1287 | CGPIA8 | 6.491 |
| 488 | cgpGmo-S1747 | CGPIA8 | 7.262 |
| 489 | cgpGmo-S412 | CGPIA8 | 8.235 |
| 490 | cgpGmo-S748 | CGPIA8 | 9.413 |
| 491 | cgpGmo-S776a | CGPIA8 | 11.039 |
| 492 | cgpGmo-S776b | CGPIA8 | 11.088 |
| 493 | cgpGmo-S2191 | CGPIA8 | 11.801 |
| 494 | cgpGmo-S1785 | CGPIA8 | 12.304 |
| 495 | cgpGmo-S1018a | CGPIA8 | 13.355 |
| 496 | cgpGmo-S597 | CGPIA8 | 13.683 |
| 497 | cgpGmo-S1820 | CGPIA8 | 13.794 |
| 498 | cgpGmo-S2002 | CGPIA8 | 14.001 |
| 499 | cgpGmo-S1430a | CGPIA8 | 14.054 |
| 500 | cgpGmo-S786 | CGPIA8 | 14.226 |
| 501 | cgpGmo-S421 | CGPIA8 | 14.226 |
| 502 | cgpGmo-S362 | CGPIA8 | 14.51 |
| 503 | cgpGmo-S1018b | CGPIA8 | 14.824 |
| 504 | cgpGmo-S332a | CGPIA8 | 16.007 |
| 505 | cgpGmo-S857 | CGPIA8 | 16.084 |
| 506 | cgpGmo-S332b | CGPIA8 | 17.992 |
| 507 | cgpGmo-S1898 | CGPIA8 | 21.791 |
| 508 | cgpGmo-S1430b | CGPIA8 | 21.848 |
| 509 | cgpGmo-S556 | CGPIA8 | 22.503 |
| 510 | cgpGmo-S562 | CGPIA8 | 22.807 |
| 511 | cgpGmo-S438 | CGPIA8 | 24.379 |
| 512 | cgpGmo-S511b | CGPIA8 | 24.609 |
| 513 | cgpGmo-S1814 | CGPIA8 | 25.025 |
| 514 | cgpGmo-S943 | CGPIA8 | 25.705 |
| 515 | cgpGmo-S1714 | CGPIA8 | 27.497 |
| 516 | cgpGmo-S891 | CGPIA8 | 29.387 |
| 517 | cgpGmo-S396 | CGPIA8 | 30.044 |
| 518 | cgpGmo-S1242 | CGPIA8 | 31.708 |
| 519 | cgpGmo-S2059 | CGPIA8 | 31.817 |
| 520 | cgpGmo-S1085b | CGPIA8 | 32.884 |
| 521 | cgpGmo-S1122 | CGPIA8 | 33.503 |
| 522 | cgpGmo-S756a | CGPIA8 | 34.303 |
| 523 | cgpGmo-S550 | CGPIA8 | 34.63 |
| 524 | cgpGmo-S509 | CGPIA8 | 35.495 |
| 525 | cgpGmo-S311b | CGPIA8 | 36.696 |
| 526 | cgpGmo-S1891 | CGPIA8 | 38.924 |
| 527 | cgpGmo-S1179 | CGPIA8 | 39.572 |
| 528 | cgpGmo-S2089 | CGPIA8 | 40.427 |
| 529 | cgpGmo-S1085a | CGPIA8 | 40.441 |
| 530 | cgpGmo-S284 | CGPIA8 | 40.441 |
| 531 | cgpGmo-S2222 | CGPIA8 | 42.779 |
| 532 | cgpGmo-S1553a | CGPIA8 | 43.633 |
| 533 | cgpGmo-S45 | CGPIA8 | 46.025 |
| 534 | cgpGmo-S751 | CGPIA8 | 47.099 |
| 535 | cgpGmo-S1370 | CGPIA8 | 47.158 |
| 536 | cgpGmo-S1708 | CGPIA8 | 48.478 |
| 537 | cgpGmo-S1276a | CGPIA8 | 49.201 |
| 538 | cgpGmo-S1748 | CGPIA8 | 49.941 |
| 539 | cgpGmo-S2054 | CGPIA8 | 50.585 |
| 540 | cgpGmo-S1779 | CGPIA8 | 50.585 |
| 541 | cgpGmo-S1713 | CGPIA8 | 51.467 |
| 542 | cgpGmo-S2104 | CGPIA8 | 51.507 |
| 543 | cgpGmo-S383 | CGPIA8 | 51.719 |
| 544 | cgpGmo-S1341 | CGPIA8 | 52.455 |
| 545 | cgpGmo-S2144 | CGPIA8 | 55.333 |
| 546 | cgpGmo-S779 | CGPIA9 | −0.005 |
| 547 | cgpGmo-S882a | CGPIA9 | 0 |
| 548 | cgpGmo-S1572 | CGPIA9 | 3.389 |
| 549 | cgpGmo-S553 | CGPIA9 | 4.01 |
| 550 | cgpGmo-S2180 | CGPIA9 | 4.366 |
| 551 | cgpGmo-S1735 | CGPIA9 | 4.537 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 552 | cgpGmo-S201 | CGPIA9 | 4.784 |
| 553 | cgpGmo-S1237 | CGPIA9 | 4.862 |
| 554 | cgpGmo-S658 | CGPIA9 | 5.99 |
| 555 | cgpGmo-S127 | CGPIA9 | 6.843 |
| 556 | cgpGmo-S998 | CGPIA9 | 7.716 |
| 557 | cgpGmo-S953 | CGPIA9 | 9.231 |
| 558 | cgpGmo-S1123 | CGPIA9 | 10.347 |
| 559 | cgpGmo-S341 | CGPIA9 | 12.632 |
| 560 | cgpGmo-S1704 | CGPIA9 | 15.357 |
| 561 | cgpGmo-S114 | CGPIA9 | 16.028 |
| 562 | cgpGmo-S259 | CGPIA9 | 16.996 |
| 563 | cgpGmo-S429 | CGPIA9 | 18.997 |
| 564 | cgpGmo-S447 | CGPIA9 | 23.648 |
| 565 | cgpGmo-S770 | CGPIA9 | 25.076 |
| 566 | cgpGmo-S1507 | CGPIA9 | 30.912 |
| 567 | cgpGmo-S30 | CGPIA9 | 32.371 |
| 568 | cgpGmo-S18 | CGPIA9 | 32.447 |
| 569 | cgpGmo-S361 | CGPIA9 | 33.337 |
| 570 | cgpGmo-S413 | CGPIA9 | 33.909 |
| 571 | cgpGmo-S1013 | CGPIA9 | 35.184 |
| 572 | cgpGmo-S1442 | CGPIA9 | 36.487 |
| 573 | cgpGmo-S572 | CGPIA9 | 36.982 |
| 574 | cgpGmo-S578 | CGPIA9 | 37.664 |
| 575 | cgpGmo-S89a | CGPIA9 | 40.149 |
| 576 | cgpGmo-S2173 | CGPIA9 | 40.304 |
| 577 | cgpGmo-S159 | CGPIA9 | 41.031 |
| 578 | cgpGmo-S1017 | CGPIA9 | 41.665 |
| 579 | cgpGmo-S1965 | CGPIA9 | 43.25 |
| 580 | cgpGmo-S1001 | CGPIA9 | 44.355 |
| 581 | cgpGmo-S682 | CGPIA9 | 44.643 |
| 582 | cgpGmo-S376 | CGPIA9 | 45.248 |
| 583 | cgpGmo-S449b | CGPIA9 | 45.601 |
| 584 | cgpGmo-S410 | CGPIA9 | 45.714 |
| 585 | cgpGmo-S544 | CGPIA9 | 46.355 |
| 586 | cgpGmo-S1031 | CGPIA9 | 46.581 |
| 587 | cgpGmo-S2016 | CGPIA9 | 46.854 |
| 588 | cgpGmo-S703 | CGPIA9 | 47.187 |
| 589 | cgpGmo-S435 | CGPIA9 | 47.49 |
| 590 | cgpGmo-S609 | CGPIA9 | 47.756 |
| 591 | cgpGmo-S309 | CGPIA9 | 49.342 |
| 592 | cgpGmo-S948 | CGPIA9 | 49.731 |
| 593 | cgpGmo-S730 | CGPIA9 | 49.962 |
| 594 | cgpGmo-S719 | CGPIA9 | 50.072 |
| 595 | cgpGmo-S1412 | CGPIA9 | 50.166 |
| 596 | cgpGmo-S1045 | CGPIA9 | 50.166 |
| 597 | cgpGmo-S1178 | CGPIA9 | 50.62 |
| 598 | cgpGmo-S1839 | CGPIA9 | 50.744 |
| 599 | cgpGmo-S874 | CGPIA9 | 52.05 |
| 600 | cgpGmo-S1377 | CGPIA9 | 52.123 |
| 601 | cgpGmo-S1092a | CGPIA9 | 53.451 |
| 602 | cgpGmo-S342 | CGPIA9 | 55.199 |
| 603 | cgpGmo-S546 | CGPIA9 | 55.295 |
| 604 | cgpGmo-S986 | CGPIA9 | 56.559 |
| 605 | cgpGmo-S1157 | CGPIA9 | 56.561 |
| 606 | cgpGmo-S1011a | CGPIA9 | 57.431 |
| 607 | cgpGmo-S1011b | CGPIA9 | 57.431 |
| 608 | cgpGmo-S1513 | CGPIA9 | 61.195 |
| 609 | cgpGmo-S746 | CGPIA9 | 63.072 |
| 610 | cgpGmo-S802 | CGPIA10 | 0 |
| 611 | cgpGmo-S1832 | CGPIA10 | 1.5 |
| 612 | cgpGmo-S115 | CGPIA10 | 2.829 |
| 613 | cgpGmo-S135 | CGPIA10 | 5.041 |
| 614 | cgpGmo-S1076a | CGPIA10 | 7.425 |
| 615 | cgpGmo-S2182 | CGPIA10 | 7.816 |
| 616 | cgpGmo-S1943 | CGPIA10 | 8.36 |
| 617 | cgpGmo-S864 | CGPIA10 | 8.477 |
| 618 | cgpGmo-S425 | CGPIA10 | 8.904 |
| 619 | cgpGmo-S1929 | CGPIA10 | 8.952 |
| 620 | cgpGmo-S1034 | CGPIA10 | 9.187 |
| 621 | cgpGmo-S516 | CGPIA10 | 9.354 |
| 622 | cgpGmo-S942 | CGPIA10 | 9.47 |
| 623 | cgpGmo-S1344 | CGPIA10 | 9.777 |
| 624 | cgpGmo-S668 | CGPIA10 | 10.113 |
| 625 | cgpGmo-S1654 | CGPIA10 | 10.179 |
| 626 | cgpGmo-S1025 | CGPIA10 | 10.336 |
| 627 | cgpGmo-S1869 | CGPIA10 | 11.874 |
| 628 | cgpGmo-S778 | CGPIA10 | 13.246 |
| 629 | cgpGmo-S2012 | CGPIA10 | 14.223 |
| 630 | cgpGmo-S37b | CGPIA10 | 16.423 |
| 631 | cgpGmo-S37a | CGPIA10 | 16.539 |
| 632 | cgpGmo-S327 | CGPIA10 | 16.744 |
| 633 | cgpGmo-S2107 | CGPIA10 | 17.336 |
| 634 | cgpGmo-S1556 | CGPIA10 | 17.362 |
| 635 | cgpGmo-S775 | CGPIA10 | 17.696 |
| 636 | cgpGmo-S479 | CGPIA10 | 17.821 |
| 637 | cgpGmo-S921 | CGPIA10 | 18.14 |
| 638 | cgpGmo-S25 | CGPIA10 | 18.485 |
| 639 | cgpGmo-S575 | CGPIA10 | 22.589 |
| 640 | cgpGmo-S448 | CGPIA10 | 23.205 |
| 641 | cgpGmo-S1273 | CGPIA10 | 23.337 |
| 642 | cgpGmo-S367 | CGPIA10 | 24.096 |
| 643 | cgpGmo-S336 | CGPIA10 | 24.31 |
| 644 | cgpGmo-S215 | CGPIA10 | 24.95 |
| 645 | cgpGmo-S1304b | CGPIA10 | 25.379 |
| 646 | cgpGmo-S1900 | CGPIA10 | 26.066 |
| 647 | cgpGmo-S1836 | CGPIA10 | 26.368 |
| 648 | cgpGmo-S313 | CGPIA10 | 26.489 |
| 649 | cgpGmo-S153a | CGPIA10 | 26.539 |
| 650 | cgpGmo-S1304a | CGPIA10 | 26.814 |
| 651 | cgpGmo-S1778 | CGPIA10 | 27.496 |
| 652 | cgpGmo-S1327a | CGPIA10 | 27.766 |
| 653 | cgpGmo-S471 | CGPIA10 | 28.152 |
| 654 | cgpGmo-S1334 | CGPIA10 | 28.175 |
| 655 | cgpGmo-S1410 | CGPIA10 | 28.763 |
| 656 | cgpGmo-S371 | CGPIA10 | 29.08 |
| 657 | cgpGmo-S49 | CGPIA10 | 30.238 |
| 658 | cgpGmo-S1490 | CGPIA10 | 30.604 |
| 659 | cgpGmo-S2153 | CGPIA10 | 30.9 |
| 660 | cgpGmo-S1098 | CGPIA10 | 31.66 |
| 661 | cgpGmo-S1866 | CGPIA10 | 32.181 |
| 662 | cgpGmo-S513 | CGPIA10 | 33.648 |
| 663 | cgpGmo-S1104 | CGPIA10 | 33.773 |
| 664 | cgpGmo-S363 | CGPIA10 | 33.773 |
| 665 | cgpGmo-S1455 | CGPIA10 | 33.773 |
| 666 | cgpGmo-S94 | CGPIA10 | 33.918 |
| 667 | cgpGmo-S1024 | CGPIA11 | 0 |
| 668 | cgpGmo-S390b | CGPIA11 | 4.557 |
| 669 | cgpGmo-S945a | CGPIA11 | 7.333 |
| 670 | cgpGmo-S245a | CGPIA11 | 8.436 |
| 671 | cgpGmo-S1009 | CGPIA11 | 8.821 |
| 672 | cgpGmo-S667 | CGPIA11 | 8.821 |
| 673 | cgpGmo-S670 | CGPIA11 | 8.983 |
| 674 | cgpGmo-S1609a | CGPIA11 | 9.87 |
| 675 | cgpGmo-S681a | CGPIA11 | 10.354 |
| 676 | cgpGmo-S245b | CGPIA11 | 10.401 |
| 677 | cgpGmo-S403 | CGPIA11 | 13.622 |
| 678 | cgpGmo-S1272 | CGPIA11 | 14.007 |
| 679 | cgpGmo-S967b | CGPIA11 | 14.008 |
| 680 | cgpGmo-S967a | CGPIA11 | 14.35 |
| 681 | cgpGmo-S1948 | CGPIA11 | 17.854 |
| 682 | cgpGmo-S1733 | CGPIA11 | 19.914 |
| 683 | cgpGmo-S455 | CGPIA11 | 22.94 |
| 684 | cgpGmo-S1484 | CGPIA11 | 26.928 |
| 685 | cgpGmo-S2232 | CGPIA11 | 29.509 |
| 686 | cgpGmo-S1548 | CGPIA11 | 32.063 |
| 687 | cgpGmo-S1541a | CGPIA11 | 32.424 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 688 | cgpGmo-S424 | CGPIA11 | 34.805 |
| 689 | cgpGmo-S618 | CGPIA11 | 35.645 |
| 690 | cgpGmo-S1802 | CGPIA11 | 35.728 |
| 691 | cgpGmo-S1925 | CGPIA11 | 36.082 |
| 692 | cgpGmo-S1222 | CGPIA11 | 39.616 |
| 693 | cgpGmo-S939 | CGPIA11 | 39.945 |
| 694 | cgpGmo-S1094 | CGPIA11 | 41.584 |
| 695 | cgpGmo-S154 | CGPIA11 | 41.584 |
| 696 | cgpGmo-S613b | CGPIA11 | 42.416 |
| 697 | cgpGmo-S691 | CGPIA11 | 43.149 |
| 698 | cgpGmo-S1063 | CGPIA11 | 43.208 |
| 699 | cgpGmo-S867 | CGPIA11 | 43.975 |
| 700 | cgpGmo-S1647 | CGPIA11 | 45.507 |
| 701 | cgpGmo-S811a | CGPIA11 | 45.925 |
| 702 | cgpGmo-S634 | CGPIA11 | 47.196 |
| 703 | cgpGmo-S1658 | CGPIA11 | 47.277 |
| 704 | cgpGmo-S4 | CGPIA11 | 47.581 |
| 705 | cgpGmo-S1108 | CGPIA11 | 48.242 |
| 706 | cgpGmo-S2179 | CGPIA11 | 50.418 |
| 707 | cgpGmo-S150 | CGPIA11 | 50.669 |
| 708 | cgpGmo-S2113 | CGPIA11 | 50.849 |
| 709 | cgpGmo-S717 | CGPIA11 | 51.155 |
| 710 | cgpGmo-S1998 | CGPIA11 | 51.75 |
| 711 | cgpGmo-S79 | CGPIA11 | 52.806 |
| 712 | cgpGmo-S1767 | CGPIA11 | 53.144 |
| 713 | cgpGmo-S1712 | CGPIA11 | 53.218 |
| 714 | cgpGmo-S1431a | CGPIA11 | 53.378 |
| 715 | cgpGmo-S2159 | CGPIA11 | 53.882 |
| 716 | cgpGmo-S788 | CGPIA11 | 54.257 |
| 717 | cgpGmo-S2017 | CGPIA11 | 54.705 |
| 718 | cgpGmo-S2211 | CGPIA11 | 54.709 |
| 719 | cgpGmo-S607 | CGPIA11 | 54.809 |
| 720 | cgpGmo-S707 | CGPIA11 | 55.13 |
| 721 | cgpGmo-S1090 | CGPIA11 | 55.193 |
| 722 | cgpGmo-S2102 | CGPIA11 | 55.357 |
| 723 | cgpGmo-S1843 | CGPIA11 | 55.756 |
| 724 | cgpGmo-S587 | CGPIA11 | 55.84 |
| 725 | cgpGmo-S386 | CGPIA11 | 56.086 |
| 726 | cgpGmo-S2005 | CGPIA11 | 56.419 |
| 727 | cgpGmo-S138 | CGPIA11 | 56.518 |
| 728 | cgpGmo-S488 | CGPIA11 | 56.917 |
| 729 | cgpGmo-S922 | CGPIA11 | 57.057 |
| 730 | cgpGmo-S44 | CGPIA11 | 57.633 |
| 731 | cgpGmo-S416b | CGPIA11 | 59.389 |
| 732 | cgpGmo-S416a | CGPIA11 | 60.308 |
| 733 | cgpGmo-S581 | CGPIA11 | 60.435 |
| 734 | cgpGmo-S580 | CGPIA11 | 60.85 |
| 735 | cgpGmo-S1384 | CGPIA11 | 67.066 |
| 736 | cgpGmo-S594 | CGPIA12 | −2.022 |
| 737 | cgpGmo-S1846 | CGPIA12 | −1.583 |
| 738 | cgpGmo-S521b | CGPIA12 | −0.385 |
| 739 | cgpGmo-S1956 | CGPIA12 | 0 |
| 740 | cgpGmo-S1995 | CGPIA12 | 1.166 |
| 741 | cgpGmo-S476 | CGPIA12 | 2.1 |
| 742 | cgpGmo-S439 | CGPIA12 | 3.326 |
| 743 | cgpGmo-S1225 | CGPIA12 | 3.842 |
| 744 | cgpGmo-S1226 | CGPIA12 | 6.532 |
| 745 | cgpGmo-S275 | CGPIA12 | 6.635 |
| 746 | cgpGmo-S936 | CGPIA12 | 7.653 |
| 747 | cgpGmo-S582 | CGPIA12 | 8.435 |
| 748 | cgpGmo-S2209 | CGPIA12 | 12.952 |
| 749 | cgpGmo-S624 | CGPIA12 | 13.754 |
| 750 | cgpGmo-S251 | CGPIA12 | 14.796 |
| 751 | cgpGmo-S248a | CGPIA12 | 15.582 |
| 752 | cgpGmo-S57 | CGPIA12 | 16.59 |
| 753 | cgpGmo-S866 | CGPIA12 | 16.674 |
| 754 | cgpGmo-S1312 | CGPIA12 | 16.674 |
| 755 | cgpGmo-S1689 | CGPIA12 | 17.322 |
| 756 | cgpGmo-S1882 | CGPIA12 | 17.322 |
| 757 | cgpGmo-S2032 | CGPIA12 | 17.327 |
| 758 | cgpGmo-S914 | CGPIA12 | 17.582 |
| 759 | cgpGmo-S596 | CGPIA12 | 17.647 |
| 760 | cgpGmo-S688 | CGPIA12 | 17.687 |
| 761 | cgpGmo-S1543 | CGPIA12 | 18.327 |
| 762 | cgpGmo-S180b | CGPIA12 | 18.327 |
| 763 | cgpGmo-S816a | CGPIA12 | 18.327 |
| 764 | cgpGmo-S372a | CGPIA12 | 18.327 |
| 765 | cgpGmo-S1260 | CGPIA12 | 18.327 |
| 766 | cgpGmo-S486 | CGPIA12 | 18.327 |
| 767 | cgpGmo-S314 | CGPIA12 | 18.496 |
| 768 | cgpGmo-S116 | CGPIA12 | 18.552 |
| 769 | cgpGmo-S417 | CGPIA12 | 18.685 |
| 770 | cgpGmo-S510 | CGPIA12 | 18.726 |
| 771 | cgpGmo-S493 | CGPIA12 | 18.952 |
| 772 | cgpGmo-S1696 | CGPIA12 | 19.081 |
| 773 | cgpGmo-S229 | CGPIA12 | 19.149 |
| 774 | cgpGmo-S1737 | CGPIA12 | 19.69 |
| 775 | cgpGmo-S636 | CGPIA12 | 19.814 |
| 776 | cgpGmo-S233 | CGPIA12 | 20.055 |
| 777 | cgpGmo-S2034 | CGPIA12 | 20.328 |
| 778 | cgpGmo-S190 | CGPIA12 | 20.489 |
| 779 | cgpGmo-S1046 | CGPIA12 | 20.994 |
| 780 | cgpGmo-S502 | CGPIA12 | 21.31 |
| 781 | cgpGmo-S256 | CGPIA12 | 22.468 |
| 782 | cgpGmo-S1769 | CGPIA12 | 22.837 |
| 783 | cgpGmo-S1193 | CGPIA12 | 23.505 |
| 784 | cgpGmo-S316 | CGPIA12 | 24.168 |
| 785 | cgpGmo-S2101 | CGPIA12 | 34.413 |
| 786 | cgpGmo-S742a | CGPIA12 | 41.271 |
| 787 | cgpGmo-S348 | CGPIA13 | −8.884 |
| 788 | cgpGmo-S1653 | CGPIA13 | −4.445 |
| 789 | cgpGmo-S2177 | CGPIA13 | −0.97 |
| 790 | cgpGmo-S1695 | CGPIA13 | 0 |
| 791 | cgpGmo-S191 | CGPIA13 | 0.304 |
| 792 | cgpGmo-S294 | CGPIA13 | 1.45 |
| 793 | cgpGmo-S1483 | CGPIA13 | 1.697 |
| 794 | cgpGmo-S1206 | CGPIA13 | 2.255 |
| 795 | cgpGmo-S2215 | CGPIA13 | 2.578 |
| 796 | cgpGmo-S820 | CGPIA13 | 3.022 |
| 797 | cgpGmo-S652 | CGPIA13 | 3.351 |
| 798 | cgpGmo-S692a | CGPIA13 | 3.832 |
| 799 | cgpGmo-S2067 | CGPIA13 | 4.113 |
| 800 | cgpGmo-S576 | CGPIA13 | 4.62 |
| 801 | cgpGmo-S2262 | CGPIA13 | 5.769 |
| 802 | cgpGmo-S949a | CGPIA13 | 9.341 |
| 803 | cgpGmo-S1097 | CGPIA13 | 15.857 |
| 804 | cgpGmo-S980 | CGPIA13 | 18.498 |
| 805 | cgpGmo-S1069 | CGPIA13 | 18.498 |
| 806 | cgpGmo-S1889 | CGPIA13 | 18.778 |
| 807 | cgpGmo-S281 | CGPIA13 | 23.265 |
| 808 | cgpGmo-S1961 | CGPIA13 | 25.95 |
| 809 | cgpGmo-S752b | CGPIA13 | 25.968 |
| 810 | cgpGmo-S1390a | CGPIA13 | 26.716 |
| 811 | cgpGmo-S752a | CGPIA13 | 29.901 |
| 812 | cgpGmo-S399 | CGPIA13 | 33.224 |
| 813 | cgpGmo-S1990 | CGPIA13 | 33.832 |
| 814 | cgpGmo-S29 | CGPIA13 | 35.922 |
| 815 | cgpGmo-S36a | CGPIA13 | 36.561 |
| 816 | cgpGmo-S36b | CGPIA13 | 36.575 |
| 817 | cgpGmo-S906 | CGPIA13 | 37.213 |
| 818 | cgpGmo-S2013 | CGPIA13 | 37.513 |
| 819 | cgpGmo-S2018 | CGPIA13 | 37.599 |
| 820 | cgpGmo-S350 | CGPIA13 | 39.978 |
| 821 | cgpGmo-S1981 | CGPIA13 | 40.993 |
| 822 | cgpGmo-S1563 | CGPIA13 | 41.908 |
| 823 | cgpGmo-S1959 | CGPIA13 | 42.508 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 824 | cgpGmo-S487 | CGPIA13 | 42.546 |
| 825 | cgpGmo-S1209 | CGPIA13 | 43.105 |
| 826 | cgpGmo-S614b | CGPIA13 | 43.37 |
| 827 | cgpGmo-S2281 | CGPIA13 | 43.541 |
| 828 | cgpGmo-S765 | CGPIA13 | 43.727 |
| 829 | cgpGmo-S1762 | CGPIA13 | 43.735 |
| 830 | cgpGmo-S881 | CGPIA13 | 43.897 |
| 831 | cgpGmo-S1639 | CGPIA13 | 44.062 |
| 832 | cgpGmo-S905 | CGPIA13 | 44.062 |
| 833 | cgpGmo-S614a | CGPIA13 | 44.46 |
| 834 | cgpGmo-S793a | CGPIA13 | 44.905 |
| 835 | cgpGmo-S2160 | CGPIA13 | 44.913 |
| 836 | cgpGmo-S2039 | CGPIA13 | 45.393 |
| 837 | cgpGmo-S220 | CGPIA13 | 45.687 |
| 838 | cgpGmo-S2028 | CGPIA13 | 45.731 |
| 839 | cgpGmo-S107 | CGPIA13 | 45.76 |
| 840 | cgpGmo-S241 | CGPIA13 | 47.516 |
| 841 | cgpGmo-S1720 | CGPIA13 | 49.028 |
| 842 | cgpGmo-S888 | CGPIA13 | 49.39 |
| 843 | cgpGmo-S217a | CGPIA13 | 52.994 |
| 844 | cgpGmo-S1977 | CGPIA13 | 53.859 |
| 845 | cgpGmo-S1219c | CGPIA14 | 0 |
| 846 | cgpGmo-S1219b | CGPIA14 | 0.025 |
| 847 | cgpGmo-S1219a | CGPIA14 | 0.025 |
| 848 | cgpGmo-S1665 | CGPIA14 | 1.25 |
| 849 | cgpGmo-S1530 | CGPIA14 | 3.15 |
| 850 | cgpGmo-S1725 | CGPIA14 | 7.134 |
| 851 | cgpGmo-S505 | CGPIA14 | 7.783 |
| 852 | cgpGmo-S1760 | CGPIA14 | 8.372 |
| 853 | cgpGmo-S1844 | CGPIA14 | 8.778 |
| 854 | cgpGmo-S252 | CGPIA14 | 9.333 |
| 855 | cgpGmo-S988 | CGPIA14 | 11.355 |
| 856 | cgpGmo-S2110 | CGPIA14 | 12.673 |
| 857 | cgpGmo-S963 | CGPIA14 | 12.822 |
| 858 | cgpGmo-S631 | CGPIA14 | 13.242 |
| 859 | cgpGmo-S577 | CGPIA14 | 13.376 |
| 860 | cgpGmo-S841 | CGPIA14 | 13.87 |
| 861 | cgpGmo-S796 | CGPIA14 | 14.022 |
| 862 | cgpGmo-S1922 | CGPIA14 | 14.09 |
| 863 | cgpGmo-S1697 | CGPIA14 | 14.197 |
| 864 | cgpGmo-S462 | CGPIA14 | 19.181 |
| 865 | cgpGmo-S427 | CGPIA14 | 19.551 |
| 866 | cgpGmo-S617 | CGPIA14 | 21.131 |
| 867 | cgpGmo-S1467 | CGPIA14 | 21.42 |
| 868 | cgpGmo-S1466b | CGPIA14 | 21.627 |
| 869 | cgpGmo-S1466a | CGPIA14 | 21.627 |
| 870 | cgpGmo-S1803 | CGPIA14 | 24.353 |
| 871 | cgpGmo-S932b | CGPIA14 | 24.805 |
| 872 | cgpGmo-S1914 | CGPIA14 | 25.094 |
| 873 | cgpGmo-S1049 | CGPIA14 | 29.476 |
| 874 | cgpGmo-S1792 | CGPIA14 | 30.507 |
| 875 | cgpGmo-S1701 | CGPIA14 | 30.96 |
| 876 | Aroma_2_1 | CGPIA14 | 32.373 |
| 877 | Aroma_1_1 | CGPIA14 | 32.388 |
| 878 | cgpGmo-S1234 | CGPIA14 | 33.594 |
| 879 | cgpGmo-S302 | CGPIA14 | 33.872 |
| 880 | Aroma_1_9 | CGPIA14 | 34.006 |
| 881 | cgpGmo-S240 | CGPIA14 | 34.123 |
| 882 | cgpGmo-S1821 | CGPIA14 | 34.921 |
| 883 | cgpGmo-S1888 | CGPIA14 | 35.323 |
| 884 | cgpGmo-S1988 | CGPIA14 | 36.018 |
| 885 | cgpGmo-S520 | CGPIA14 | 36.056 |
| 886 | cgpGmo-S1424b | CGPIA14 | 36.474 |
| 887 | cgpGmo-S1968 | CGPIA14 | 36.573 |
| 888 | cgpGmo-S411 | CGPIA14 | 36.8 |
| 889 | cgpGmo-S2078 | CGPIA14 | 36.922 |
| 890 | cgpGmo-S70 | CGPIA14 | 37.423 |
| 891 | cgpGmo-S827 | CGPIA14 | 37.903 |
| 892 | cgpGmo-S1080 | CGPIA14 | 39.732 |
| 893 | cgpGmo-S226 | CGPIA14 | 39.967 |
| 894 | cgpGmo-S1394a | CGPIA14 | 42.56 |
| 895 | cgpGmo-S1280 | CGPIA14 | 43.692 |
| 896 | 1057C1CO1.398 | CGPIA14 | 44.092 |
| 897 | cgpGmo-S1186 | CGPIA14 | 44.159 |
| 898 | cgpGmo-S965 | CGPIA14 | 44.317 |
| 899 | cgpGmo-S824 | CGPIA14 | 52.754 |
| 900 | cgpGmo-S142 | CGPIA14 | 53.824 |
| 901 | cgpGmo-S711b | CGPIA14 | 54.095 |
| 902 | cgpGmo-S503 | CGPIA14 | 55.34 |
| 903 | cgpGmo-S249 | CGPIA14 | 61.013 |
| 904 | cgpGmo-S583 | CGPIA14 | 62.095 |
| 905 | cgpGmo-S551 | CGPIA14 | 63.269 |
| 906 | cgpGmo-S1783 | CGPIA14 | 63.361 |
| 907 | FshB_1_1 | CGPIA14 | 67.201 |
| 908 | cgpGmo-S92 | CGPIA15 | 0 |
| 909 | HSD_2_1 | CGPIA15 | 10.41 |
| 910 | cgpGmo-S1048 | CGPIA15 | 15.284 |
| 911 | cgpGmo-S1752 | CGPIA15 | 20.943 |
| 912 | cgpGmo-S1905 | CGPIA15 | 21.78 |
| 913 | cgpGmo-S2093 | CGPIA15 | 24.461 |
| 914 | cgpGmo-S1770 | CGPIA15 | 24.461 |
| 915 | cgpGmo-S677 | CGPIA15 | 27.108 |
| 916 | cgpGmo-S676 | CGPIA15 | 28.475 |
| 917 | cgpGmo-S608 | CGPIA15 | 28.788 |
| 918 | cgpGmo-S1621 | CGPIA15 | 29.322 |
| 919 | cgpGmo-S298 | CGPIA15 | 29.717 |
| 920 | cgpGmo-S591 | CGPIA15 | 32.334 |
| 921 | cgpGmo-S1781 | CGPIA15 | 33.806 |
| 922 | cgpGmo-S1728 | CGPIA15 | 35.152 |
| 923 | cgpGmo-S1577 | CGPIA15 | 36.43 |
| 924 | cgpGmo-S1899 | CGPIA15 | 37.159 |
| 925 | cgpGmo-S629 | CGPIA15 | 37.173 |
| 926 | cgpGmo-S1896 | CGPIA15 | 38.025 |
| 927 | cgpGmo-S1773 | CGPIA15 | 39.18 |
| 928 | cgpGmo-S1784 | CGPIA15 | 39.771 |
| 929 | cgpGmo-S909 | CGPIA15 | 42.239 |
| 930 | cgpGmo-S238 | CGPIA15 | 42.397 |
| 931 | cgpGmo-S1920 | CGPIA15 | 42.535 |
| 932 | cgpGmo-S1707 | CGPIA15 | 43.61 |
| 933 | cgpGmo-S296 | CGPIA15 | 45.183 |
| 934 | cgpGmo-S1201 | CGPIA15 | 45.228 |
| 935 | cgpGmo-S2142 | CGPIA15 | 46.618 |
| 936 | cgpGmo-S2178 | CGPIA15 | 47.391 |
| 937 | cgpGmo-S687 | CGPIA15 | 48.153 |
| 938 | cgpGmo-S1755 | CGPIA15 | 48.215 |
| 939 | cgpGmo-S1077b | CGPIA15 | 48.647 |
| 940 | cgpGmo-S1650 | CGPIA15 | 49.878 |
| 941 | cgpGmo-S726 | CGPIA15 | 51.839 |
| 942 | cgpGmo-S46a | CGPIA15 | 58.665 |
| 943 | cgpGmo-S1082 | CGPIA15 | 60.22 |
| 944 | cgpGmo-S696 | CGPIA15 | 62.392 |
| 945 | cgpGmo-S602 | CGPIA15 | 63.507 |
| 946 | cgpGmo-S1057a | CGPIA15 | 63.863 |
| 947 | cgpGmo-S1938 | CGPIA15 | 64.068 |
| 948 | cgpGmo-S1035 | CGPIA15 | 64.599 |
| 949 | cgpGmo-S542 | CGPIA15 | 65.308 |
| 950 | cgpGmo-S1649 | CGPIA15 | 67.501 |
| 951 | cgpGmo-S46b | CGPIA15 | 71.949 |
| 952 | cgpGmo-S972 | CGPIA16 | 0 |
| 953 | cgpGmo-S2166 | CGPIA16 | 0.303 |
| 954 | cgpGmo-S1350 | CGPIA16 | 2.678 |
| 955 | cgpGmo-S2085 | CGPIA16 | 4.777 |
| 956 | cgpGmo-S111b | CGPIA16 | 6.3 |
| 957 | cgpGmo-S111a | CGPIA16 | 6.3 |
| 958 | cgpGmo-S464 | CGPIA16 | 6.329 |
| 959 | cgpGmo-S2224 | CGPIA16 | 10.638 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 960 | cgpGmo-S109 | CGPIA16 | 11.333 |
| 961 | cgpGmo-S1339 | CGPIA16 | 11.622 |
| 962 | cgpGmo-S1032 | CGPIA16 | 13.163 |
| 963 | cgpGmo-S195 | CGPIA16 | 18.386 |
| 964 | SL_2_1 | CGPIA16 | 20.41 |
| 965 | cgpGmo-S2287 | CGPIA16 | 22.321 |
| 966 | cgpGmo-S1797 | CGPIA16 | 22.831 |
| 967 | cgpGmo-S497 | CGPIA16 | 23.681 |
| 968 | cgpGmo-S1761 | CGPIA16 | 26.779 |
| 969 | cgpGmo-S1941 | CGPIA16 | 27.456 |
| 970 | cgpGmo-S1608 | CGPIA16 | 28.367 |
| 971 | cgpGmo-S113 | CGPIA16 | 30.156 |
| 972 | cgpGmo-S2126 | CGPIA16 | 32.081 |
| 973 | cgpGmo-S533b | CGPIA16 | 32.095 |
| 974 | cgpGmo-S1664 | CGPIA16 | 32.309 |
| 975 | cgpGmo-S1347 | CGPIA16 | 32.418 |
| 976 | cgpGmo-S1281 | CGPIA16 | 32.488 |
| 977 | cgpGmo-S842 | CGPIA16 | 32.488 |
| 978 | cgpGmo-S1188 | CGPIA16 | 32.637 |
| 979 | cgpGmo-S944 | CGPIA16 | 33.803 |
| 980 | cgpGmo-S2106 | CGPIA16 | 34.909 |
| 981 | cgpGmo-S1243b | CGPIA16 | 36.685 |
| 982 | cgpGmo-S600 | CGPIA16 | 36.685 |
| 983 | cgpGmo-S1243a | CGPIA16 | 36.685 |
| 984 | cgpGmo-S213 | CGPIA16 | 39.835 |
| 985 | cgpGmo-S1947 | CGPIA16 | 42.392 |
| 986 | cgpGmo-S1140 | CGPIA16 | 42.479 |
| 987 | cgpGmo-S392 | CGPIA16 | 43.582 |
| 988 | cgpGmo-S2174 | CGPIA16 | 44.961 |
| 989 | cgpGmo-S508 | CGPIA16 | 44.962 |
| 990 | cgpGmo-S504 | CGPIA16 | 44.964 |
| 991 | cgpGmo-S515 | CGPIA16 | 45.708 |
| 992 | cgpGmo-S1042a | CGPIA16 | 47.38 |
| 993 | cgpGmo-S1290 | CGPIA16 | 48.108 |
| 994 | cgpGmo-S401 | CGPIA16 | 48.548 |
| 995 | cgpGmo-S1042b | CGPIA16 | 48.667 |
| 996 | cgpGmo-S415 | CGPIA16 | 48.715 |
| 997 | cgpGmo-S287a | CGPIA16 | 49.034 |
| 998 | cgpGmo-S1073 | CGPIA16 | 49.051 |
| 999 | cgpGmo-S627 | CGPIA16 | 49.394 |
| 1000 | cgpGmo-S2164 | CGPIA16 | 50.165 |
| 1001 | cgpGmo-S287b | CGPIA16 | 50.901 |
| 1002 | cgpGmo-S2263 | CGPIA16 | 51.414 |
| 1003 | cgpGmo-S2138 | CGPIA16 | 53.067 |
| 1004 | cgpGmo-S1457 | CGPIA16 | 53.208 |
| 1005 | cgpGmo-S463b | CGPIA16 | 54.433 |
| 1006 | cgpGmo-S300 | CGPIA16 | 56.582 |
| 1007 | cgpGmo-S437 | CGPIA16 | 64.659 |
| 1008 | cgpGmo-S1265b | CGPIA17 | 0 |
| 1009 | cgpGmo-S561 | CGPIA17 | 1.627 |
| 1010 | cgpGmo-S1172 | CGPIA17 | 1.779 |
| 1011 | cgpGmo-S777 | CGPIA17 | 3.72 |
| 1012 | cgpGmo-S285 | CGPIA17 | 3.998 |
| 1013 | cgpGmo-S1617 | CGPIA17 | 4.221 |
| 1014 | cgpGmo-S1265c | CGPIA17 | 5.986 |
| 1015 | cgpGmo-S104 | CGPIA17 | 6.382 |
| 1016 | cgpGmo-S904 | CGPIA17 | 8.895 |
| 1017 | cgpGmo-S276b | CGPIA17 | 11.798 |
| 1018 | cgpGmo-S2220 | CGPIA17 | 13.247 |
| 1019 | cgpGmo-S541b | CGPIA17 | 13.71 |
| 1020 | cgpGmo-S541a | CGPIA17 | 14.938 |
| 1021 | cgpGmo-S727 | CGPIA17 | 15.001 |
| 1022 | cgpGmo-S2184 | CGPIA17 | 17.777 |
| 1023 | cgpGmo-S879 | CGPIA17 | 18.331 |
| 1024 | cgpGmo-S2169 | CGPIA17 | 19.486 |
| 1025 | cgpGmo-S1974 | CGPIA17 | 20.882 |
| 1026 | cgpGmo-S566 | CGPIA17 | 20.941 |
| 1027 | cgpGmo-S565 | CGPIA17 | 20.995 |
| 1028 | cgpGmo-S1006 | CGPIA17 | 24.562 |
| 1029 | cgpGmo-S1041 | CGPIA17 | 27.147 |
| 1030 | cgpGmo-S878 | CGPIA17 | 28.572 |
| 1031 | cgpGmo-S1780 | CGPIA17 | 37.043 |
| 1032 | cgpGmo-S2212 | CGPIA17 | 37.354 |
| 1033 | cgpGmo-S1056 | CGPIA17 | 37.727 |
| 1034 | cgpGmo-S1655 | CGPIA17 | 38.284 |
| 1035 | cgpGmo-S1738 | CGPIA17 | 38.959 |
| 1036 | cgpGmo-S955 | CGPIA17 | 38.969 |
| 1037 | cgpGmo-S381 | CGPIA17 | 43.977 |
| 1038 | 334C1CO1.411 | CGPIA17 | 46.969 |
| 1039 | cgpGmo-S1864 | CGPIA17 | 46.969 |
| 1040 | cgpGmo-S616 | CGPIA17 | 48.124 |
| 1041 | cgpGmo-S650b | CGPIA17 | 56.539 |
| 1042 | cgpGmo-S2041 | CGPIA18 | 0 |
| 1043 | cgpGmo-S9b | CGPIA18 | 0.875 |
| 1044 | cgpGmo-S2162 | CGPIA18 | 1.044 |
| 1045 | cgpGmo-S813 | CGPIA18 | 1.573 |
| 1046 | cgpGmo-S1474 | CGPIA18 | 2.2 |
| 1047 | cgpGmo-S1323 | CGPIA18 | 2.222 |
| 1048 | cgpGmo-S2139 | CGPIA18 | 3.65 |
| 1049 | cgpGmo-S1294 | CGPIA18 | 5.795 |
| 1050 | cgpGmo-S2175 | CGPIA18 | 11.354 |
| 1051 | cgpGmo-S84 | CGPIA18 | 13.122 |
| 1052 | cgpGmo-S958 | CGPIA18 | 13.909 |
| 1053 | cgpGmo-S706 | CGPIA18 | 14.289 |
| 1054 | cgpGmo-S1774 | CGPIA18 | 15.899 |
| 1055 | cgpGmo-S861 | CGPIA18 | 16.776 |
| 1056 | cgpGmo-S2259 | CGPIA18 | 19.295 |
| 1057 | cgpGmo-S2027 | CGPIA18 | 20.186 |
| 1058 | cgpGmo-S1300a | CGPIA18 | 21.768 |
| 1059 | cgpGmo-S197a | CGPIA18 | 25.357 |
| 1060 | cgpGmo-S601 | CGPIA18 | 26.346 |
| 1061 | cgpGmo-S2077 | CGPIA18 | 27.663 |
| 1062 | cgpGmo-S1441 | CGPIA18 | 29.273 |
| 1063 | cgpGmo-S331b | CGPIA18 | 29.676 |
| 1064 | cgpGmo-S1055a | CGPIA18 | 31.219 |
| 1065 | cgpGmo-S1918 | CGPIA18 | 31.219 |
| 1066 | cgpGmo-S1435 | CGPIA18 | 31.27 |
| 1067 | cgpGmo-S330 | CGPIA18 | 31.776 |
| 1068 | cgpGmo-S1115 | CGPIA18 | 32.176 |
| 1069 | cgpGmo-S1117 | CGPIA18 | 32.336 |
| 1070 | cgpGmo-S1710 | CGPIA18 | 32.464 |
| 1071 | cgpGmo-S442a | CGPIA18 | 32.467 |
| 1072 | cgpGmo-S1095 | CGPIA18 | 33.189 |
| 1073 | cgpGmo-S1379 | CGPIA18 | 34.778 |
| 1074 | cgpGmo-S391 | CGPIA18 | 35.855 |
| 1075 | cgpGmo-S1340 | CGPIA18 | 38.158 |
| 1076 | cgpGmo-S1992 | CGPIA18 | 39.202 |
| 1077 | cgpGmo-S916 | CGPIA18 | 39.529 |
| 1078 | cgpGmo-S97 | CGPIA18 | 40.002 |
| 1079 | cgpGmo-S684 | CGPIA18 | 40.123 |
| 1080 | cgpGmo-S1818 | CGPIA18 | 42.196 |
| 1081 | cgpGmo-S1520 | CGPIA18 | 42.201 |
| 1082 | cgpGmo-S900 | CGPIA18 | 44.65 |
| 1083 | cgpGmo-S975b | CGPIA18 | 46.292 |
| 1084 | cgpGmo-S975a | CGPIA18 | 48.44 |
| 1085 | cgpGmo-S1083 | CGPIA18 | 49.174 |
| 1086 | cgpGmo-S2187 | CGPIA19 | 0 |
| 1087 | cgpGmo-S557 | CGPIA19 | 0.053 |
| 1088 | cgpGmo-S108 | CGPIA19 | 1.707 |
| 1089 | cgpGmo-S1408 | CGPIA19 | 5.157 |
| 1090 | cgpGmo-S1834 | CGPIA19 | 11.603 |
| 1091 | cgpGmo-S247 | CGPIA19 | 13.05 |
| 1092 | cgpGmo-S1837 | CGPIA19 | 15.633 |
| 1093 | cgpGmo-S918 | CGPIA19 | 16.422 |
| 1094 | cgpGmo-S1740 | CGPIA19 | 17.604 |
| 1095 | cgpGmo-S649a | CGPIA19 | 21.388 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 1096 | cgpGmo-S665 | CGPIA19 | 23.427 |
| 1097 | cgpGmo-S495 | CGPIA19 | 24.147 |
| 1098 | cgpGmo-S649b | CGPIA19 | 26.271 |
| 1099 | cgpGmo-S621 | CGPIA19 | 28.113 |
| 1100 | cgpGmo-S2120 | CGPIA19 | 29.31 |
| 1101 | cgpGmo-S1385a | CGPIA19 | 29.483 |
| 1102 | cgpGmo-S1385b | CGPIA19 | 29.793 |
| 1103 | cgpGmo-S586 | CGPIA19 | 34.172 |
| 1104 | cgpGmo-S1944 | CGPIA19 | 35.093 |
| 1105 | cgpGmo-S1105 | CGPIA19 | 35.205 |
| 1106 | cgpGmo-S374 | CGPIA19 | 37.04 |
| 1107 | cgpGmo-S328 | CGPIA19 | 38.165 |
| 1108 | cgpGmo-S329 | CGPIA19 | 38.165 |
| 1109 | cgpGmo-S911 | CGPIA19 | 39.153 |
| 1110 | cgpGmo-S2143 | CGPIA19 | 39.59 |
| 1111 | cgpGmo-S633 | CGPIA19 | 41.345 |
| 1112 | cgpGmo-S1005 | CGPIA19 | 41.366 |
| 1113 | cgpGmo-S436 | CGPIA19 | 41.98 |
| 1114 | cgpGmo-S1528a | CGPIA19 | 43.698 |
| 1115 | cgpGmo-S642 | CGPIA19 | 44.72 |
| 1116 | cgpGmo-S1489 | CGPIA19 | 44.72 |
| 1117 | cgpGmo-S443 | CGPIA19 | 45.652 |
| 1118 | cgpGmo-S1775 | CGPIA19 | 48.839 |
| 1119 | cgpGmo-S366 | CGPIA19 | 50.409 |
| 1120 | cgpGmo-S271 | CGPIA19 | 50.773 |
| 1121 | cgpGmo-S767 | CGPIA19 | 54.661 |
| 1122 | cgpGmo-S2130 | CGPIA19 | 54.96 |
| 1123 | cgpGmo-S297 | CGPIA19 | 55.085 |
| 1124 | cgpGmo-S1461a | CGPIA19 | 56.108 |
| 1125 | cgpGmo-S1014b | CGPIA19 | 56.211 |
| 1126 | cgpGmo-S193 | CGPIA19 | 56.329 |
| 1127 | cgpGmo-S1700 | CGPIA19 | 56.378 |
| 1128 | cgpGmo-S1028 | CGPIA19 | 56.652 |
| 1129 | cgpGmo-S124 | CGPIA19 | 56.723 |
| 1130 | cgpGmo-S1461b | CGPIA19 | 57.424 |
| 1131 | cgpGmo-S2161 | CGPIA20 | 0 |
| 1132 | cgpGmo-S995b | CGPIA20 | 1.045 |
| 1133 | cgpGmo-S1204 | CGPIA20 | 2.274 |
| 1134 | cgpGmo-S2114 | CGPIA20 | 2.274 |
| 1135 | cgpGmo-S1297a | CGPIA20 | 6.04 |
| 1136 | cgpGmo-S1348 | CGPIA20 | 6.231 |
| 1137 | cgpGmo-S2269 | CGPIA20 | 6.634 |
| 1138 | cgpGmo-S854b | CGPIA20 | 6.724 |
| 1139 | cgpGmo-S501 | CGPIA20 | 8.184 |
| 1140 | cgpGmo-S559 | CGPIA20 | 9.114 |
| 1141 | cgpGmo-S149 | CGPIA20 | 9.796 |
| 1142 | cgpGmo-S995a | CGPIA20 | 9.958 |
| 1143 | cgpGmo-S1423a | CGPIA20 | 11.497 |
| 1144 | cgpGmo-S1392 | CGPIA20 | 13.154 |
| 1145 | cgpGmo-S661b | CGPIA20 | 14.136 |
| 1146 | cgpGmo-S661a | CGPIA20 | 14.136 |
| 1147 | cgpGmo-S1742 | CGPIA20 | 14.162 |
| 1148 | cgpGmo-S1667 | CGPIA20 | 14.671 |
| 1149 | cgpGmo-S1857 | CGPIA20 | 15.955 |
| 1150 | cgpGmo-S599 | CGPIA20 | 16.217 |
| 1151 | cgpGmo-S632a | CGPIA20 | 17.033 |
| 1152 | cgpGmo-S1945 | CGPIA20 | 17.062 |
| 1153 | cgpGmo-S632b | CGPIA20 | 17.168 |
| 1154 | cgpGmo-S693 | CGPIA20 | 17.353 |
| 1155 | cgpGmo-S1391 | CGPIA20 | 19.17 |
| 1156 | cgpGmo-S637 | CGPIA20 | 21.711 |
| 1157 | cgpGmo-S1454 | CGPIA20 | 27.868 |
| 1158 | cgpGmo-S1184 | CGPIA20 | 32.098 |
| 1159 | cgpGmo-S357 | CGPIA20 | 33.925 |
| 1160 | cgpGmo-S1362 | CGPIA20 | 33.98 |
| 1161 | cgpGmo-S695 | CGPIA20 | 34.521 |
| 1162 | cgpGmo-S143 | CGPIA20 | 34.566 |
| 1163 | cgpGmo-S635 | CGPIA20 | 36.107 |
| 1164 | cgpGmo-S1503 | CGPIA20 | 36.639 |
| 1165 | cgpGmo-S196 | CGPIA20 | 38.981 |
| 1166 | cgpGmo-S525 | CGPIA20 | 41.002 |
| 1167 | cgpGmo-S2201 | CGPIA20 | 41.03 |
| 1168 | cgpGmo-S431 | CGPIA20 | 41.104 |
| 1169 | cgpGmo-S1401 | CGPIA20 | 49.716 |
| 1170 | cgpGmo-S1482 | CGPIA20 | 51.903 |
| 1171 | cgpGmo-S218 | CGPIA20 | 51.933 |
| 1172 | cgpGmo-S2198 | CGPIA20 | 54.177 |
| 1173 | cgpGmo-S1807 | CGPIA20 | 55.581 |
| 1174 | cgpGmo-S1093 | CGPIA21 | 0 |
| 1175 | cgpGmo-S1573 | CGPIA21 | 0.934 |
| 1176 | cgpGmo-S772 | CGPIA21 | 1.23 |
| 1177 | cgpGmo-S1794 | CGPIA21 | 1.779 |
| 1178 | cgpGmo-S225a | CGPIA21 | 2.934 |
| 1179 | cgpGmo-S2283 | CGPIA21 | 3.655 |
| 1180 | cgpGmo-S315 | CGPIA21 | 3.993 |
| 1181 | cgpGmo-S1706 | CGPIA21 | 6.054 |
| 1182 | cgpGmo-S130 | CGPIA21 | 6.247 |
| 1183 | cgpGmo-S225b | CGPIA21 | 6.392 |
| 1184 | cgpGmo-S1084 | CGPIA21 | 6.417 |
| 1185 | cgpGmo-S794 | CGPIA21 | 7.995 |
| 1186 | cgpGmo-S1316 | CGPIA21 | 8.771 |
| 1187 | cgpGmo-S925 | CGPIA21 | 9.125 |
| 1188 | cgpGmo-S2097 | CGPIA21 | 9.261 |
| 1189 | cgpGmo-S2171 | CGPIA21 | 10.156 |
| 1190 | cgpGmo-S858 | CGPIA21 | 11.297 |
| 1191 | cgpGmo-S698 | CGPIA21 | 11.433 |
| 1192 | cgpGmo-S1741 | CGPIA21 | 12.138 |
| 1193 | cgpGmo-S91 | CGPIA21 | 12.756 |
| 1194 | cgpGmo-S853 | CGPIA21 | 14.259 |
| 1195 | Hsp90 | CGPIA21 | 15.65 |
| 1196 | cgpGmo-S2055 | CGPIA21 | 16.574 |
| 1197 | cgpGmo-S1465 | CGPIA21 | 18.629 |
| 1198 | cgpGmo-S1646 | CGPIA21 | 19.653 |
| 1199 | cgpGmo-S954 | CGPIA21 | 20.57 |
| 1200 | cgpGmo-S120 | CGPIA21 | 20.958 |
| 1201 | cgpGmo-S1255b | CGPIA21 | 22.052 |
| 1202 | cgpGmo-S1926 | CGPIA21 | 22.525 |
| 1203 | cgpGmo-S947 | CGPIA21 | 22.69 |
| 1204 | cgpGmo-S1255a | CGPIA21 | 22.967 |
| 1205 | cgpGmo-S1972 | CGPIA21 | 24.019 |
| 1206 | cgpGmo-S224 | CGPIA21 | 24.079 |
| 1207 | cgpGmo-S1342 | CGPIA21 | 24.219 |
| 1208 | cgpGmo-S697 | CGPIA21 | 25.675 |
| 1209 | cgpGmo-S907 | CGPIA21 | 26.917 |
| 1210 | cgpGmo-S675a | CGPIA21 | 28.335 |
| 1211 | cgpGmo-S2063 | CGPIA21 | 31.746 |
| 1212 | cgpGmo-S423 | CGPIA21 | 32.505 |
| 1213 | cgpGmo-S459 | CGPIA21 | 41.011 |
| 1214 | cgpGmo-S808 | CGPIA21 | 41.279 |
| 1215 | cgpGmo-S579 | CGPIA21 | 41.493 |
| 1216 | cgpGmo-S1702 | CGPIA21 | 41.539 |
| 1217 | cgpGmo-S549 | CGPIA21 | 42.157 |
| 1218 | cgpGmo-S1003 | CGPIA21 | 44.071 |
| 1219 | cgpGmo-S679 | CGPIA21 | 45.185 |
| 1220 | cgpGmo-S2183 | CGPIA22 | 0 |
| 1221 | cgpGmo-S740 | CGPIA22 | 0.894 |
| 1222 | cgpGmo-S1705 | CGPIA22 | 2.974 |
| 1223 | cgpGmo-S1552b | CGPIA22 | 4.344 |
| 1224 | cgpGmo-S1552a | CGPIA22 | 4.379 |
| 1225 | cgpGmo-S1799 | CGPIA22 | 4.807 |
| 1226 | cgpGmo-S1919 | CGPIA22 | 4.866 |
| 1227 | cgpGmo-S1852 | CGPIA22 | 7.229 |
| 1228 | cgpGmo-S20 | CGPIA22 | 7.87 |
| 1229 | cgpGmo-S2121 | CGPIA22 | 8.356 |
| 1230 | cgpGmo-S1691 | CGPIA22 | 9.014 |
| 1231 | cgpGmo-S1417 | CGPIA22 | 13.602 |

TABLE 10-continued

SNP Linkage Map Linkage groups for second generation genetic linkage map to be used for QTL analysis. This map contains all the markers that it has been possible to place on the map, has been generated using three families, B30, B33 and B87, and JoinMap ® 4 has been allowed to force the maximum number of markers into each linkage group. Markers with the prefix cgpGmo have been developed by the CGP and are novel; markers with alternative nomenclature have been provided by other groups, or have been published previously (e.g. 2311C1CO1.535).

| Nr | Locus | Group | Position |
|---|---|---|---|
| 1232 | cgpGmo-S997b | CGPIA22 | 13.917 |
| 1233 | cgpGmo-S206 | CGPIA22 | 15.369 |
| 1234 | cgpGmo-S1909 | CGPIA22 | 15.853 |
| 1235 | cgpGmo-S382 | CGPIA22 | 17.351 |
| 1236 | cgpGmo-S2125 | CGPIA22 | 17.566 |
| 1237 | cgpGmo-S1335 | CGPIA22 | 18.541 |
| 1238 | cgpGmo-S2105 | CGPIA22 | 18.672 |
| 1239 | cgpGmo-S1106 | CGPIA22 | 18.966 |
| 1240 | cgpGmo-S1643 | CGPIA22 | 22.843 |
| 1241 | cgpGmo-S13b | CGPIA22 | 23.068 |
| 1242 | cgpGmo-S996 | CGPIA22 | 23.939 |
| 1243 | 155C1CO1.193 | CGPIA22 | 24.01 |
| 1244 | cgpGmo-S2242 | CGPIA22 | 25.091 |
| 1245 | cgpGmo-S1904 | CGPIA22 | 25.305 |
| 1246 | cgpGmo-S1578 | CGPIA22 | 25.305 |
| 1247 | cgpGmo-S258 | CGPIA22 | 26.054 |
| 1248 | cgpGmo-S1659 | CGPIA22 | 27.523 |
| 1249 | cgpGmo-S2288 | CGPIA22 | 33.444 |
| 1250 | cgpGmo-S2186 | CGPIA22 | 34.653 |
| 1251 | cgpGmo-S2108 | CGPIA22 | 34.909 |
| 1252 | cgpGmo-S822a | CGPIA22 | 36.419 |
| 1253 | cgpGmo-S1382 | CGPIA22 | 36.896 |
| 1254 | cgpGmo-S1308 | CGPIA22 | 37.333 |
| 1255 | cgpGmo-S263 | CGPIA22 | 37.333 |
| 1256 | cgpGmo-S1957 | CGPIA22 | 38.172 |
| 1257 | 5681C1CO1.227 | CGPIA22 | 39.997 |
| 1258 | cgpGmo-S1657 | CGPIA22 | 40.184 |
| 1259 | cgpGmo-S1718 | CGPIA22 | 40.477 |
| 1260 | cgpGmo-S962b | CGPIA22 | 41.857 |
| 1261 | cgpGmo-S1310 | CGPIA22 | 46.161 |
| 1262 | cgpGmo-S28 | CGPIA22 | 59.459 |
| 1263 | cgpGmo-S805 | CGPIA22 | 59.459 |
| 1264 | cgpGmo-S1804 | CGPIA22 | 69.959 |
| 1265 | cgpGmo-S1008 | CGPIA23 | 0 |
| 1266 | cgpGmo-S418 | CGPIA23 | 0.802 |
| 1267 | cgpGmo-S1596a | CGPIA23 | 1.273 |
| 1268 | cgpGmo-S1766 | CGPIA23 | 2.647 |
| 1269 | cgpGmo-S1071a | CGPIA23 | 4.577 |
| 1270 | cgpGmo-S335 | CGPIA23 | 4.779 |
| 1271 | cgpGmo-S1622 | CGPIA23 | 5.906 |
| 1272 | cgpGmo-S227 | CGPIA23 | 6.682 |
| 1273 | cgpGmo-S626a | CGPIA23 | 6.752 |
| 1274 | cgpGmo-S626b | CGPIA23 | 7.065 |
| 1275 | 5911C1CO1.447 | CGPIA23 | 7.758 |
| 1276 | cgpGmo-S2218 | CGPIA23 | 16.686 |
| 1277 | cgpGmo-S529 | CGPIA23 | 18.251 |
| 1278 | cgpGmo-S897 | CGPIA23 | 18.251 |
| 1279 | cgpGmo-S1202 | CGPIA23 | 19.399 |
| 1280 | cgpGmo-S623 | CGPIA23 | 20.777 |
| 1281 | cgpGmo-S838a | CGPIA23 | 22.042 |
| 1282 | cgpGmo-S528 | CGPIA23 | 22.84 |
| 1283 | cgpGmo-S458a | CGPIA23 | 22.988 |
| 1284 | cgpGmo-S849 | CGPIA23 | 23.314 |
| 1285 | cgpGmo-S1250 | CGPIA23 | 23.479 |
| 1286 | cgpGmo-S351 | CGPIA23 | 23.983 |
| 1287 | cgpGmo-S1903 | CGPIA23 | 25.086 |
| 1288 | cgpGmo-S606a | CGPIA23 | 25.086 |
| 1289 | cgpGmo-S722 | CGPIA23 | 25.086 |
| 1290 | cgpGmo-S1506 | CGPIA23 | 25.405 |
| 1291 | cgpGmo-S606b | CGPIA23 | 25.423 |
| 1292 | cgpGmo-S1475 | CGPIA23 | 26.35 |
| 1293 | cgpGmo-S2086 | CGPIA23 | 27.898 |
| 1294 | 2311C1CO1.535 | CGPIA23 | 28.516 |
| 1295 | cgpGmo-S272 | CGPIA23 | 31.582 |
| 1296 | cgpGmo-S994 | CGPIA23 | 31.644 |
| 1297 | cgpGmo-S2035 | CGPIA23 | 32.016 |
| 1298 | cgpGmo-S1320 | CGPIA23 | 39.83 |

TABLE 11

SNPs that that are monomorphic from Eastern Atlantic cod populations tested (Iceland, Ireland and Norway) and polymorphic in Western Atlantic cod populations.

| SNP_name | New name | SNP_name | New name |
|---|---|---|---|
| 5909C1CO1.1049 | cgpGmo-S807 | 3987C1CO1.739 | cgpGmo-S1903 |
| 5643C1CO1.151 | cgpGmo-S2029 | 3beta670 | cgpGmo-S1117 |
| 5279C1CO1.392 | cgpGmo-S2279 | 4016C1CO1.62 | cgpGmo-S1905 |
| 4823C1CO1.458 | cgpGmo-S694 | 4048C1CO1.570 | cgpGmo-S1394b |
| 2332C1CO1.139 | cgpGmo-S357 | 4109C1CO1.558 | cgpGmo-S613b |
| 10377C1CO1.101 | cgpGmo-S1653 | 412C2CO1.581 | cgpGmo-S614b |
| 10590C1CO1.513 | cgpGmo-S1660 | 414C1CO1.432 | cgpGmo-S1919 |
| 1125C1CO1.153 | cgpGmo-S1178 | 4427C1CO1.243 | cgpGmo-S1945 |
| 11916C1CO1.209 | cgpGmo-S1673 | 4517C1CO1.551 | cgpGmo-S1952 |
| 1215C1CO1.327 | cgpGmo-S180a | 4649C1CO1.962 | cgpGmo-S1962 |
| 1414C1CO1.566 | cgpGmo-S1689 | 4748C1CO1.393 | cgpGmo-S1435 |
| 1428C2CO1.182 | cgpGmo-S217a | 4863C1CO1.276 | cgpGmo-S1977 |
| 1497C1CO1.102 | cgpGmo-S1209 | 4888C1CO1.932 | cgpGmo-S1445 |
| 1557C1CO1.255 | cgpGmo-S1213c | 5209C1CO1.196 | cgpGmo-S2003 |
| 1630C3CO1.531 | cgpGmo-S1707 | 5275C1CO1.461 | cgpGmo-S2008 |
| 1733C1CO1.202 | cgpGmo-S1714 | 5322C1CO1.297 | cgpGmo-S1461b |
| 1754C2CO1.245 | cgpGmo-S1716 | 5325C2CO1.319 | cgpGmo-S2011 |
| 1898C1CO1.530 | cgpGmo-S1242 | 5370C1CO1.568 | cgpGmo-S752b |
| 2052C1CO1.474 | cgpGmo-S1736 | 5375C1CO2.398 | cgpGmo-S1466b |
| 2075C1CO1.706 | cgpGmo-S1737 | 5655C1CO1.488 | cgpGmo-S2031 |
| 2107C2CO1.110 | cgpGmo-S1255b | 5854C1CO1.475 | cgpGmo-S1489 |
| 2118C1CO1.434 | cgpGmo-S1741 | 5886C1CO1.527 | cgpGmo-S2047 |
| 2143C1CO1.182 | cgpGmo-S1258a | 5895C1CO1.188 | cgpGmo-S2049 |
| 2177C1CO1.202 | cgpGmo-S338a | 6314C1CO1.109 | cgpGmo-S2074 |

TABLE 11-continued

SNPs that that are monomorphic from Eastern Atlantic cod populations tested (Iceland, Ireland and Norway) and polymorphic in Western Atlantic cod populations.

| SNP_name | New name | SNP_name | New name |
|---|---|---|---|
| 2220C1CO1.459 | cgpGmo-S59a | 6558C1CO1.582 | cgpGmo-S2091 |
| 2306C2CO1.268 | cgpGmo-S1764 | 6675C1CO1.512 | cgpGmo-S2097 |
| 2337C1CO1.284 | cgpGmo-S1273 | 6704C1CO1.367 | cgpGmo-S2098 |
| 2361C1CO1.632 | cgpGmo-S1767 | 6728C1CO1.428 | cgpGmo-S882a |
| 2539C1CO1.218 | cgpGmo-S385b | 6746C2CO1.793 | cgpGmo-S2099 |
| 262C1CO1.163 | cgpGmo-S1291 | 677C1CO1.540 | cgpGmo-S890b |
| 2756C4CO1.469 | cgpGmo-S1302 | 679C1CO1.356 | cgpGmo-S2102 |
| 2779C1CO1.229 | cgpGmo-S1795 | 6903C1CO1.213 | cgpGmo-S1543 |
| 2814C1CO1.108 | cgpGmo-S430a | 724C1CO1.555 | cgpGmo-S1553b |
| 2917C2CO1.452 | cgpGmo-S1809 | 7288C1CO1.182 | cgpGmo-S1556 |
| 2929C1CO1.64 | cgpGmo-S1315 | 7333C1CO1.612 | cgpGmo-S2130 |
| 2957C1CO1.841 | cgpGmo-S1813 | 7421C1CO1.345 | cgpGmo-S2136 |
| 2968C1CO1.121 | cgpGmo-S458a | 7468C1CO1.284 | cgpGmo-S2140 |
| 2993C1CO1.495 | cgpGmo-S1320 | 7565C1CO1.470 | cgpGmo-S2145 |
| 3002C1CO1.472 | cgpGmo-S463b | 8332C1CO1.229 | cgpGmo-S1014a |
| 336C1CO1.89 | cgpGmo-S1847 | 846C1CO1.541 | cgpGmo-S1608 |
| 3411C1CO1.411 | cgpGmo-S1346 | 8672C1CO1.556 | cgpGmo-S2183 |
| 346C1CO1.463 | cgpGmo-S1858 | 9176C1CO1.128 | cgpGmo-S2199 |
| 3539C1CO1.797 | cgpGmo-S1354 | 9323C1CO1.439 | cgpGmo-S46b |
| 3590C1CO1.517 | cgpGmo-S1868 | 9456C1CO1.448 | cgpGmo-S2208 |
| all_v2.1182.C3.404 | cgpGmo-S1121 | 4404C1CO1.224 | cgpGmo-S644 |
| all_v2.4.C42.1238 | cgpGmo-S1142 | 4664C2CO1.271 | cgpGmo-S672 |
| 10078C1CO1.320 | cgpGmo-S124 | 466C1CO1.619 | cgpGmo-S673 |
| 10330C1CO1.584 | cgpGmo-S134 | 466C2CO1.340 | cgpGmo-S674 |
| 10580C1CO1.134 | cgpGmo-S142 | 4773C1CO1.458 | cgpGmo-S688 |
| 1073C1CO1.202 | cgpGmo-S147 | 4866C1CO1.262 | cgpGmo-S699b |
| 1215C1CO1.596 | cgpGmo-S180b | 4936C1CO1.161 | cgpGmo-S706 |
| 132C1CO1.1121 | cgpGmo-S207 | 4961C2CO1.220 | cgpGmo-S710 |
| 1347C2CO1.580 | cgpGmo-S210 | 528C1CO1.1038 | cgpGmo-S94 |
| 1470C1CO1.120 | cgpGmo-S221a | 5431C1CO1.324 | cgpGmo-S757 |
| 1673C2CO1.405 | cgpGmo-S261a | 5472C1CO1.337 | cgpGmo-S758 |
| 1742C1CO1.369 | cgpGmo-S275 | 5645C1CO1.1566 | cgpGmo-S779 |
| 1780C1CO1.581 | cgpGmo-S281 | 6003C1CO1.427 | cgpGmo-S821 |
| 1851C2CO1.600 | cgpGmo-S289 | 6156C1CO1.442 | cgpGmo-S835 |
| 1878C1CO1.634 | cgpGmo-S291 | 638C1CO1.415 | cgpGmo-S853 |
| 193C2CO1.193 | cgpGmo-S302 | 6511C1CO1.374 | cgpGmo-S865 |
| 2040C2CO1.850 | cgpGmo-S322 | 666C1CO1.341 | cgpGmo-S878 |
| 2048C1CO1.312 | cgpGmo-S324 | 672C2CO1.309 | cgpGmo-S883 |
| 2126C1CO1.342 | cgpGmo-S334 | 7158C1CO1.350 | cgpGmo-S927 |
| 2153C2CO1.693 | cgpGmo-S57 | 7201C1CO1.450 | cgpGmo-S930 |
| 2185C1CO1.519 | cgpGmo-S339 | 727C1CO1.856 | cgpGmo-S103 |
| 2244C1CO1.338 | cgpGmo-S1265a | 7456C1CO1.351 | cgpGmo-S951b |
| 2296C6CO1.459 | cgpGmo-S351 | 7514C1CO1.267 | cgpGmo-S107 |
| 2308C2CO1.226 | cgpGmo-S352 | 7537C1CO1.337 | cgpGmo-S958 |
| 2545C1CO1.366 | cgpGmo-S388 | 7696C1CO1.426 | cgpGmo-S110 |
| 2617C2CO1.465 | cgpGmo-S399 | 781C1CO1.305 | cgpGmo-S982a |
| 270C2CO1.126 | cgpGmo-S411 | 7852C1CO1.926 | cgpGmo-S984 |
| 2805C1CO1.1000 | cgpGmo-S428 | 8083C1CO1.458 | cgpGmo-S997a |
| 2826C1CO1.252 | cgpGmo-S433 | 8195C2CO1.467 | cgpGmo-S1598a |
| 2895C1CO1.348 | cgpGmo-S444 | 829C1CO1.716 | cgpGmo-S1011b |
| 2906C1CO1.115 | cgpGmo-S68 | 8355C1CO1.403 | cgpGmo-S1016 |
| 290C1CO1.627 | cgpGmo-S446 | 8428C1CO1.521 | cgpGmo-S115 |
| 3097C1CO1.589 | cgpGmo-S475 | 8518C1CO1.523 | cgpGmo-S6 |
| 3129C1CO1.316 | cgpGmo-S478 | 8590C1CO1.487 | cgpGmo-S1032 |
| 3157C1CO1.686 | cgpGmo-S481 | 85C1CO1.261 | cgpGmo-S1034 |
| 3238C1CO1.625 | cgpGmo-S490 | 8831C1CO1.119 | cgpGmo-S1044 |
| 325C1CO1.835 | cgpGmo-S493 | 8852C2CO1.180 | cgpGmo-S1045 |
| 3330C1CO1.353 | cgpGmo-S504 | 8876C1CO1.97 | cgpGmo-S1049 |
| 3384C1CO1.157 | cgpGmo-S513 | 8898C1CO1.316 | cgpGmo-S1050 |
| 3530C1CO1.317 | cgpGmo-S536 | 9008C1CO1.522 | cgpGmo-S1056 |
| 3569C1CO1.391 | cgpGmo-S541b | 913C2CO1.505 | cgpGmo-S1062 |
| 3700C1CO1.185 | cgpGmo-S556 | 95C1CO1.548 | cgpGmo-S1087b |
| 373C1CO1.221 | cgpGmo-S560 | 9682C1CO1.765 | cgpGmo-S1093 |
| 3753C2CO1.291 | cgpGmo-S563 | 968C1CO1.536 | cgpGmo-S1095 |
| 3863C1CO1.284 | cgpGmo-S577 | 9732C1CO1.311 | cgpGmo-S1097 |
| 3899C1CO1.483 | cgpGmo-S584 | | |
| 3912C1CO1.393 | cgpGmo-S588 | | |
| 3965C2CO1.185 | cgpGmo-S593 | | |
| 412C2CO1.446 | cgpGmo-S614a | | |
| 4345C1CO1.634 | cgpGmo-S638b | | |
| 437C1CO1.241 | cgpGmo-S642 | | |

TABLE 12

Set of associated genotypes (21 SNPs identified on 20 contigs) that distinguish Southern
[South (Ire, Ireland)] and Northern [North (Nor, Norway - Barents Sea)] populations.

| Population | SNP_Name | | | | | | | | | | | | | | |
|---|---|---|---|---|---|---|---|---|---|---|---|---|---|---|---|
| | cgpGmo-S152 | cgpGmo-S157 | cgpGmo-S183 | cgpGmo-S268 | cgpGmo-S352 | cgpGmo-S419 | cgpGmo-S673 | cgpGmo-S739 | cgpGmo-S814a | cgpGmo-S870 | cgpGmo-S920 | cgpGmo-S982a | cgpGmo-S1039b | cgpGmo-S1089 | cgpGmo-S1183 |
| SOUTH(Ire) | C | C | A | A | G | G | C | T | C | T | A | A | T | T | G |
| SOUTH (Ice) | C | C | A | A | G | G | C | T | C | T | A | A | T | T | G |
| SOUTH (GB) | C | C | A | A | G | G | C | T | C | *T/C* | A | A | T | T | G |
| SOUTH (CS) | C | C | A | A | G | G | C | T | C | *T/C* | A | A | T | T | G |
| NORTH(Nor) | T | T | *A/G* | T | G | A | C | C | T | C | C | A | G | C | A |
| NORTH (Ice) | T | T | *A/G* | T | G | A | C | C | T | C | C | A | G | C | A |
| NORTH (GB) | T | T | *A/G* | T | *C/G* | A | *A/C* | C | T | C | C | *A/G* | G | C | A |
| NORTH (CS) | T | T | *A/G* | T | *C/G* | A | C | C | T | C | C | A | G | C | A |
| NORTH (NL_YC2) | T | T | *A/G* | T | *C/G* | A | *A/C* | C | T | C | C | *A/G* | G | C | A |
| NORTH (NL_YC3) | T | T | *A/G* | T | *C/G* | A | *A/C* | C | T | C | C | *A/G* | G | C | A |
| SNP sequence | [T/C] | [T/C] | [A/G] | [A/T] | [C/G] | [A/G] | [A/C] | [T/C] | [T/C] | [A/C] | [A/G] | [T/G] | [T/C] | [A/G] |

| Population | SNP_Name | | | | | | Number of individuals homozygous for major S or N genotype | Total number of individuals tested for that population |
|---|---|---|---|---|---|---|---|---|
| | cgpGmo-S1810 | cgpGmo-S1830 | cgpGmo-S1425 | cgpGmo-S1991 | cgpGmo-S2158 | cgpGmo-S1039a | | |
| SOUTH(Ire) | T | A | G | G | G | G | 14 | 15 |
| SOUTH (Ice) | T | A | G | G | G | G | 7 | 26 |
| SOUTH (GB) | T | A | G | G | G | G | 7 | 23 |
| SOUTH (CS) | T | A | G | G | G | G | 12 | 23 |
| NORTH(Nor) | G | G | *T/G* | *T/G* | A | A | 26 | 26 |
| NORTH (Ice) | G | G | *T/G* | *T/G* | A | A | 8 | 26 |
| NORTH (GB) | G | G | *T/G* | *T/G* | A | A | 6 | 23 |
| NORTH (CS) | G | G | *T/G* | *T/G* | A | A | 2 | 23 |
| NORTH (NL_YC2) | G | G | *T/G* | *T/G* | A | A | 23 | 23 |
| NORTH (NL_YC3) | G | G | *T/G* | *T/G* | A | A | 23 | 23 |
| SNP sequence | [T/G] | [A/G] | [T/G] | [T/G] | [A/G] | [A/G] | | |

Several populations (Ire, Ireland; Ice, Iceland; GB, Georges Bank; CS, Cape Sable; NL_YC2, fish from Newfoundland Bay Bulls population that were also used to generate Newfoundland breeding program second year class progeny; NL_YC3, fish from Newfoundland Smith Sound population that were also used to generate Newfoundland breeding program third year class progeny) were genotyped to determine which set or sets of associated genotypes were present. Where results were variable for given populations, genotypes for the populations are listed under both South (Ire, Ireland) and North (Nor, Norway Barents Sea) sets of associated genotypes. The SNP substitution originally detected in the sequence data is provided at the bottom of the table. Data in italics demonstrate where optional bases were found for specific SNPs in certain populations. It should be noted that for SNP cgpGmo-S870, T to C transition substitutions were only found in 2 of 7 homozygous individuals from GB, and in 1 of 12 in individuals from CS. SNP names where the SNPs are from the same contig are marked with bold font.

TABLE 13

SNPs that overlap with those described in Moen et al. (2008).

| CGP_SNP_Name | New name | SNP name from Moen et al. 2008 | SNP panel |
|---|---|---|---|
| 1057C1CO1.398 | #N/A | Gm1001_0189 | Panel 1 |
| 155C1CO1.193 | #N/A | Gm0986_0621 | Panel 1 |
| 2311C1CO1.535 | #N/A | Gm1205_0365 | Panel 1 |
| 334C1CO1.411 | #N/A | Gm0399_0241 | Panel 1 |
| 5279C2CO1.498 | #N/A | Gm0766_0315 | Panel 1 |
| 5681C1CO1.227 | #N/A | Gm370_0380 | Panel 1 |
| 5911C1CO1.447 | #N/A | Gm159_0228 | Panel 1 |
| 1534C1CO1.626 | cgpGmo-S232b | Gm0685_0303 | Panel 2 |
| 1959C2CO1.349 | cgpGmo-S1730 | Gm1174_0311 | Panel 2 |
| 4440C1CO1.1126 | cgpGmo-S649b | Gm328_0124 | Panel 2 |

TABLE 14

Properties of SNPs used for experimental testing of family assignment panel. SNPs selected for parental assignment are shown, with their chromosomal position (Cm), and minor allele frequency (MAF) as determined by Illumina GoldenGate genotyping of multiple Atlantic cod populations. Two map positions are provided, the first from the initial version of the genetic map that was created using two family crosses (See Example 2; FIG. 5), and the second (New) genetic map from an updated map generated after adding an additional family (Table 10).

| SNP name | Linkage group | Position (Cm) | Position (Cm) New | MAF |
|---|---|---|---|---|
| cgpGmo_s305 | 2 | | 3.426 | 0.4588 |
| cgpGmo_s1743 | 2 | 12.52 | 13.889 | 0.4323 |
| cgpGmo_s1217 | 2 | 51.914 | 51.137 | 0.4236 |
| cgpGmo_s646 | 3 | | 16.28 | 0.4892 |
| cgpGmo_s1979 | 4 | 33.693 | 28.626 | 0.4269 |
| cgpGmo_s205 | 4 | 39.111 | 31.162 | 0.4219 |
| cgpGmo_s1698 | 4 | | 59.88 | 0.488 |
| cgpGmo_s2069 | 5 | 17.797 | 12.113 | 0.4258 |
| cgpGmo_s977 | 5 | 29.694 | 26.336 | 0.4555 |
| cgpGmo_s1787 | 5 | 35.082 | 30.546 | 0.44 |
| cgpGmo_s774 | 5 | 45.796 | 37.607 | 0.4967 |
| cgpGmo_s60 | 6 | 42.927 | 40.601 | 0.449 |
| cgpGmo_s1820 | 8 | 13.99 | 13.794 | 0.4716 |

TABLE 14-continued

Properties of SNPs used for experimental testing of family assignment panel. SNPs selected for parental assignment are shown, with their chromosomal position (Cm), and minor allele frequency (MAF) as determined by Illumina GoldenGate genotyping of multiple Atlantic cod populations. Two map positions are provided, the first from the initial version of the genetic map that was created using two family crosses (See Example 2; FIG. 5), and the second (New) genetic map from an updated map generated after adding an additional family (Table 10).

| SNP name | Linkage group | Position (Cm) | Position (Cm) New | MAF |
|---|---|---|---|---|
| cgpGmo_s362 | 8 | 13.946 | 14.51 | 0.4154 |
| cgpGmo_s2089 | 8 | 41.027 | 40.427 | 0.4629 |
| cgpGmo_s2222 | 8 |  | 42.779 | 0.4945 |
| cgpGmo_s1965 | 9 | 55.179 | 43.25 | 0.4334 |
| cgpGmo_s1001 | 9 | 57.131 | 44.355 | 0.4902 |
| cgpGmo_s410 | 9 | 56.294 | 45.714 | 0.4132 |
| cgpGmo_s1098 | 10 | 50.784 | 31.66 | 0.4458 |
| cgpGmo_s403 | 11 | 9.547 | 13.622 | 0.4534 |
| cgpGmo_s154 | 11 |  | 41.584 | 0.4382 |
| cgpGmo_s488 | 11 | 51.537 | 56.917 | 0.4306 |
| cgpGmo_s1225 | 12 |  | 3.842 | 0.4334 |
| cgpGmo_s251 | 12 |  | 14.796 | 0.4111 |
| cgpGmo_s866 | 12 | 33.657 | 16.674 | 0.4371 |
| cgpGmo_s233 | 12 | 33.772 | 20.055 | 0.4848 |
| cgpGmo_s932 | 14 | 30.36 | 24.805 | 0.461 |
| cgpGmo_s909 | 15 | 42.264 | 42.239 | 0.4067 |
| cgpGmo_s1032 | 16 |  | 13.163 | 0.4631 |
| cgpGmo_s1265 | 17 | 8.163 | 0 | 0.4334 |
| cgpGmo_s727 | 17 | 24.154 | 15.001 | 0.4403 |
| cgpGmo_s1864 | 17 |  | 46.969 | 0.4323 |
| cgpGmo_s900 | 18 | 52.06 | 44.65 | 0.4718 |
| cgpGmo_s2187 | 19 | 1.019 | 0 | 0.4345 |
| cgpGmo_s247 | 19 | 10.512 | 13.05 | 0.4642 |
| cgpGmo_s1385 | 19 | 23.833 | 29.483 | 0.4563 |
| cgpGmo_s328 | 19 |  | 38.165 | 0.4479 |
| cgpGmo_s767 | 19 | 54.792 | 54.661 | 0.4664 |
| cgpGmo_s193 | 19 | 54.274 | 56.329 | 0.4469 |
| cgpGmo_s661 | 20 | 11.711 | 14.136 | 0.4837 |
| cgpGmo_s1659 | 22 | 28.547 | 27.523 | 0.4563 |
| cgpGmo_s1168 |  |  |  | 0.4727 |
| cgpGmo_s1440 |  |  |  | 0.417 |
| cgpGmo_s1498 |  |  |  | 0.4127 |
| cgpGmo_s1593 |  |  |  | 0.4793 |
| cgpGmo_s1606 |  |  |  | 0.4094 |
| cgpGmo_s1631 |  |  |  | 0.4869 |

TABLE 15

Genotyping errors associated with SNPs after experimental testing. SNP S1001 generated a large percentage of total errors, and is highlighted in grey.

| SNP name | Number of errors | Percentage of total |
|---|---|---|
| cgpGmo_s205 | 9 | 15.8 |
| cgpGmo_s1743 | 1 | 1.8 |
| cgpGmo_s362 | 3 | 5.3 |
| cgp_Gmo_s403 | 1 | 1.8 |
| cgpGmo_s1965 | 1 | 1.8 |
| cgpGmo_s767 | 1 | 1.8 |
| cgpGmo_s909 | 8 | 14.0 |
| cgpGmo_s977 | 6 | 10.5 |
| cgpGmo_s1001 | 23 | 40.4 |
| cgpGmo_s1032 | 1 | 1.8 |
| cgpGmo_s1631 | 2 | 3.5 |
| cgpGmo_s1168 | 1 | 1.8 |
| Total | 57 | 100.0 |

TABLE 16

Genotyping errors generated per family. The dams and sires giving rise to each family cross are shown. All family crosses were generated as part of the NB selective breeding program. Sire M1330 and dam F182 were associated with a large percentage of total genotyping errors and are highlighted in grey.

| Family | Dam | Sire | Number of errors | Percentage of total errors |
|---|---|---|---|---|
| B03 | F181 | M1082 | 6 | 10.5 |
| B04 | F177 | M1171 | 2 | 3.5 |
| B06 | F177 | M1186 | 1 | 1.8 |
| B09 | F180 | M1186 | 0 | 0.0 |
| B13 | F180 | M1157 | 2 | 3.5 |
| B16 | F329 | M1324 | 2 | 3.5 |
| B21 | F49 | M1330 | 10 | 17.5 |
| B22 | F49 | M1035 | 1 | 1.8 |
| B23 | F182 | M1082 | 9 | 15.8 |
| B24 | F182 | M1330 | 6 | 10.5 |
| B28 | F49 | M1126 | 4 | 7.0 |
| B33 | F2 | M1013 | 2 | 3.5 |
| B34 | F2 | M1023 | 0 | 0.0 |
| B35 | F395 | M1013 | 4 | 7.0 |
| B37 | F275 | M1278 | 3 | 5.3 |
| B51 | F163 | M1108 | 5 | 8.8 |
| Total |  |  | 57 | 100 |

TABLE 17

Determining the minimal SNP set required for correct parental assignment. SNPs were sequentially removed from the panel, with the reduced SNP set tested for its ability to correctly assign parents.

| Number of SNPs in panel | Correct assignment (%) | Ambiguous assignment (%) | Incorrect assignment (%) |
|---|---|---|---|
| 48 | 100 |  |  |
| 36 | 100 |  |  |
| 30 | 100 |  |  |
| 24 | 98.9 | 1.1 |  |
| 20 | 94.6 | 4.3 | 1.1 |
| 16 | 84.9 | 12.9 | 2.2 |

TABLE 18

SNPs and alleles associated with nodavirus resistance in codfish

| SNP | linkage group | Preferred Allele | p-value | FDR p-value | Position (cM) |
|---|---|---|---|---|---|
| cgpGmo-S557 | 19 | C | 0.0003 | 0.01538 | 0.053 |
| cgpGmo-S943 | 8 | T | 0.0011 | 0.06983 | 25.705 |
| cgpGmo-1596a | 23 | A | 0.0043 | 0.08600 | 1.273 |
| cgpGmo-S1071a | 23 | T | 0.0057 | 0.08600 | 4.577 |

TABLE 19

Descriptive statistics for SL (cm), Wt (g), BledWt (g), GonadWt (g), LiverWt (g), HOGWt (g), SOnFWt (g), SOffFWt (g) measurements taken at harvest.

| Trait | Mean | Min | Max | Std |
|---|---|---|---|---|
| SL | 44.4 | 29.5 | 52.2 | 4.0 |
| Wt | 1504.5 | 325.0 | 2543.0 | 465.9 |
| BledWt | 1479.3 | 310.0 | 2511.4 | 456.9 |
| GonadWt | 97.0 | 0.5 | 316.6 | 53.8 |
| LiverWt | 172.2 | 12.6 | 335.9 | 73.3 |
| HOGWt | 1155.7 | 280.1 | 1953.2 | 341.1 |
| SOnWt | 598.0 | 120.2 | 1088.0 | 197.5 |
| SOffWt | 522.3 | 98.0 | 962.0 | 179.6 |

TABLE 20

SNPs associated with measures of weight. Preferred alleles are associated with increased weight

| Linkage Group | Preferred Allele | FDR p-value | Position (cM) | Locus Name | Trait |
|---|---|---|---|---|---|
| 7 | C | 0.04229 | 5.704 | cgpGmo-S833 | Wt, |
|   |   | 0.0481 |   |   | BledWt |
| 7 | C | 0.04229 | 6.228 | cgpGmo-S834 | Wt, |
|   |   | 0.0481 |   |   | BledWt |
| 7 | A | 0.04229 | 19.147 | cgpGmo-S268 | Wt, |
|   |   | 0.0481 |   |   | BledWt, |
|   |   | 0.00398 |   |   | HOGWt |
| 7 | G | 0.04229 | 19.147 | cgpGmo-S1183 | Wt, |
|   |   | 0.0481 |   |   | BledWt, |
|   |   | 0.00398 |   |   | HOGWt |
| 7 | G | 0.04229 | 19.147 | cgpGmo-S2158 | Wt, |
|   |   | 0.0481 |   |   | BledWt |
|   |   | 0.00398 |   |   | HOGWt |
| 7 | T | 0.04229 | 19.147 | cgpGmo-S1039b | Wt, |
|   |   | 0.0481 |   |   | BledWt, |
|   |   | 0.00398 |   |   | HOGWt |
| 7 | A | 0.04229 | 19.147 | cgpGmo-S1830 | Wt, |
|   |   | 0.0481 |   |   | BledWt, |
|   |   | 0.00398 |   |   | HOGWt |
| 7 | C | 0.04229 | 19.147 | cgpGmo-S157 | Wt, |
|   |   | 0.0481 |   |   | BledWt |
|   |   | 0.00398 |   |   | HOGWt |
| 7 | T | 0.0192 | 19.147 | cgpGmo-S870 | HOGWt |
| 7 | G | 0.04229 | 19.147 | cgpGmo-S419 | Wt, |
|   |   | 0.0481 |   |   | BledWt |
|   |   | 0.00398 |   |   | HOGWt |
| 7 | G | 0.02525 | 19.147 | cgpGmo-S352 | HOGWt |
| 7 | A | 0.04229 | 19.147 | cgpGmo-S920 | Wt, |
|   |   | 0.0481 |   |   | BledWt |
|   |   | 0.00398 |   |   | HOGWt |
| 7 | C | 0.04229 | 19.147 | cgpGmo-S152 | Wt, |
|   |   | 0.0481 |   |   | BledWt |
|   |   | 0.00398 |   |   | HOGWt |
| 7 | T | 0.04229 | 19.147 | cgpGmo-S1089 | Wt, |
|   |   | 0.0481 |   |   | BledWt |
|   |   | 0.00398 |   |   | HOGWt |
| 7 | G | 0.0444 | 19.147 | cgpGmo-S1039a | Wt |
|   |   | 0.00398 |   |   | HOGWt |
| 7 | C | 0.04229 | 19.147 | cgpGmo-S814a | Wt, |
|   |   | 0.0481 |   |   | BledWt |
|   |   | 0.00398 |   |   | HOGWt |
| 7 | G | 0.02497 | 19.147 | cgpGmo-S1425 | HOGWt |
| 7 | T | 0.04229 | 19.147 | cgpGmo-S1810 | Wt, |
|   |   | 0.0481 |   |   | BledWt |
|   |   | 0.00398 |   |   | HOGWt |
| 7 | C | 0.01057 | 22.341 | cgpGmo-S1644 | HOGWt |

TABLE 21

List of SNPs not on linkage group 7 with significant associations.

| linkage group | Preferred Allele | FDR p-value | Position (cM) | Locus Name | Trait |
|---|---|---|---|---|---|
| 11 | T | 0.0325 | 45.925 | cgpGmo-S811a | SOnWt |
|   |   | 0.0260 |   |   | SOffWt |
| 23 | C | 0.0093 | 5.906 | cgpGmo-S1622 | SOnWt |
|   |   | 0.0372 |   |   | SOffWt |
| 18 | A (−) | 0.0430 | 35.855 | cgpGmo-S391 | GonadWt |
| 22 | G (−) | 0.0126 | 33.444 | cgpGmo-S2288 | GonadWt |
| 1 | A (−) | 0.0280 | 27.89 | cgpGmo-S1579 | LiverWt |
| 23 | A (−) | 0.0403 | 23.314 | cgpGmo-S849 | LiverWt |

(−) indicates a preferred allele associated with a reduction in weight

TABLE 22

List of 21 single nucleotide polymorphisms associated with gender: linkage group, F value, false discovery rate p value, position of SNP in linkage group, locus name.

| Linkage Group | F | FDR p-value | Position (cM) | Locus Name |
|---|---|---|---|---|
| 11 | 5.96 | 0.01138 | 13.622 | cgpGmo-S403 |
| 11 | 12.77 | 0.00006 | 35.645 | cgpGmo-S618 |
| 11 | 4.95 | 0.026 | 35.728 | cgpGmo-S1802 |
| 11 | 31.91 | 0 | 41.584 | cgpGmo-S154 |
| 11 | 15.32 | 0.00001 | 43.149 | cgpGmo-S691 |
| 11 | 8.26 | 0.00177 | 43.208 | cgpGmo-S1063 |
| 11 | 19.58 | 0 | 43.975 | cgpGmo-S867 |
| 11 | 8.11 | 0.01797 | 45.507 | cgpGmo-S1647 |
| 11 | 7.11 | 0.0045 | 47.196 | cgpGmo-S634 |
| 11 | 9.79 | 0.00068 | 47.277 | cgpGmo-S1658 |
| 11 | 4.66 | 0.03282 | 47.581 | cgpGmo-S4 |
| 11 | 11.67 | 0.00379 | 53.144 | cgpGmo-S1767 |
| 11 | 10.28 | 0.0005 | 54.705 | cgpGmo-S2017 |
| 11 | 9.55 | 0.00072 | 54.709 | cgpGmo-S2211 |
| 11 | 9.32 | 0.00072 | 55.193 | cgpGmo-S1090 |
| 11 | 6.02 | 0.01138 | 56.419 | cgpGmo-S2005 |
| 11 | 10.83 | 0.00511 | 56.518 | cgpGmo-S138 |
| 11 | 8.18 | 0.00177 | 56.917 | cgpGmo-S488 |
| 11 | 25 | 0 | 57.633 | cgpGmo-S44 |
| 11 | 5.25 | 0.02058 | 59.389 | cgpGmo-S416b |
| 15 | 6.83 | 0.0492 | 48.153 | cgpGmo-S687 |

TABLE 23

Summary statistics for Z Score, Mean Cortisol, Resting Cortisol, Mean Weight (g) for association analysis in Example 7.

| Trait | Mean | Min | Max | Std |
|---|---|---|---|---|
| Zt Score | 0.11 | −1.05 | 1.70 | 0.73 |
| Mean Cortisol | 108.61 | 18.08 | 264.86 | 58.73 |
| Resting Cortisol | 42.87 | 0.10 | 426.50 | 69.48 |
| Mean Weight | 155.37 | 38.40 | 362.39 | 64.59 |

TABLE 24

List of SNPs associated with change in cortisol level and the alleles associated with a smaller change in cortisol level, false discovery rate p value, and position of SNP in linkage group.

| linkage group | Preferred Allele | fdr_p | Position (cM) | Locus Name |
|---|---|---|---|---|
| 6 | A | 0.0174 | 3.382 | cgpGmo-S848 |
| 13 | C | 0.00002 | 42.546 | cgpGmo-S487 |
| 18 | T | 0.0287 | 48.440 | cgpGmo-S975a |
| 20 | T | 0.0369 | 41.030 | cgpGmo-S525 |

REFERENCES

Altschul S F, Gish W, Miller W, Myers E W, J. LD: Basic local alignment search tool. *Journal of Molecular Biology* 1990, 5:403-410.

Anderson, E. C., Garza, J. C., 2006. The power of single-nucleotide polymorphisms for large-scale parentage inference. Genetics. 172, 2567-2582.

Baruch, E., Weller, J. I., 2008. Estimation of the number of SNP genetic markers required for parentage verification. Anim Genet. 39, 474-479.

Benjamini, Y. and Y. Hochberg. 1995. Controlling the false discovery rate: a practical and powerful approach to multiple testing. J. R. Stat. Soc. Ser. B., 57:289-300.

Bonaldo M F, Lennon G, Soares M B: Normalization and subtraction: two approaches to facilitate gene discovery. *Genome Research* 1996, 6:791-806.

Bowman, S., Higgins, B., Stone, C., Kozera, C., Curtis, B. A., Tarrant Bussey, J., Kimball, J., Verheul, H., Johnson, S. C., 2007. Generation of genomics resources for Atlantic cod (*Gadus morhua*): progress and plans. Bulletin of the Aquaculture Association of Canada. 105, 24-30.

Bricknell, I. R., J. E. Bron and T. J. Bowden. 2006. Diseases of gadoid fish in cultivation: a review. ICES Journal of Marine Science, 63:253-266.

Brown, J. A., Minkoff, G., Puvanendran, V., 2003. Larviculture of Atlantic cod (*Gadus morhua*): progress, protocols and problems. Aquaculture. 227, 357-372.

Campbell, N. R., Overturf, K., Narum, S. R., 2009. Characterization of 22 novel single nucleotide polymorphism markers in steelhead and rainbow trout. Molecular Ecology Resources. 9, 318-322.

Cenadelli, S., Maran, V., Bongioni, G., Fusetti, L., Parma, P., Aleandri, R., 2007. Identification of nuclear SNPs in gilthead seabream. Journal of Fish Biology. 70, 399-405.

Christie, M. R., 2009. Parentage in natural populations: novel methods to detect parent-offspring pairs in large data sets. Molecular Ecology Resources.

Danzmann, R. G., 1997. PROBMAX: a computer program for assigning unknown parentage in pedigree analysis from known genotypic pools of parents and progeny. Journal of Heredity. 88, 333.

Delghandi, M., Mortensen, A., Westgaard, J. I., 2003. Simultaneous analysis of six microsatellite markers in Atlantic cod (*Gadus morhua*): a novel multiplex assay system for use in selective breeding studies. Marine Biotechnology. 5, 141-148.

Delghandi M, Wesmajervi M S, Mennen S, Nilsen F: Development of twenty sequence-tagged microsatellites for the Atlantic cod (*Gadus morhua* L.). *Conservation Genetics* 2008, 9(5):1395-1398.

Delghandi M, Wesmajervi M S, Tafese T, Nilsen F: Twenty-three novel microsatellite markers developed from Atlantic cod (*Gadus morhua* L.) expressed sequence tags. *Journal of Fish Biology* 2008, 73(2):444-449.

Devlin, R. H., Nagahama, Y., 2002. Sex determination and sex differentiation in fish: an overview of genetic, physiological, and environmental influences. Aquaculture. 208, 191-364.

Fan Z, Fox D P: Robertsonian polymorphism in plaice, *Pleuronectes platessa* L., and cod, *Gadus morhua* L. (Pisces Pleuronectiformes and Gadiformes). *Journal of Fish Biology* 1991, 38:635-640.

Feng C Y, Johnson S C, Hori T, Rise M, Hall J R, Gamperl A K, Hubert S, Kimball J, Bowman S, Rise M L: Identification and analysis of differentially expressed genes in immune tissues of Atlantic cod stimulated with formalin-killed atypical *Aeromonas salmonicida*. *Physiological Genomics* 2009.

Garber, A. F., S. E. Fordham, J. E. Symonds, E. A. Trippel and D. L. Berlinsky. 2009. Hormone-induced ovulation and spermiation in Atlantic cod (*Gadus morhua*). Aquaculture, 296:179-183.

Gjedrem, T., 2000. Genetic improvement of coldwater fish species. Aquaculture Research. 31, 25-33.

Glaubitz, J. C., Rhodes, E., Dewoody, A., 2003. Prospects for inferring pairwise relationships with single nucleotide polymorphisms. Molecular Ecology. 12, 1039-1047.

Gorbach, D. M., Hu, Z.-L., Du, Z.-Q., Rothschild, M. F., 2008. SNP discovery in Litopenaeus vannamei with a new computational pipeline. Anim Genet. 40, 106-109.

Guryev V, Koudijs M J, Berezikov E, Johnson S L, Plasterk R H, van Eeden F J, Cuppen E: Genetic variation in the zebrafish. *Genome Research* 2006, 16(4):491-497.

Guryev V, Berezikov E, Malik R, Plasterk R H, Cuppen E: Single nucleotide polymorphisms associated with rat expressed sequences. *Genome Res* 2004, 14(7):1438-1443.

Hayes, B., Sonesson, A. K., Gjerde, B., 2005. Evaluation of three strategies using DNA markers for traceability in aquaculture species. Aquaculture. 250, 70-81.

Hayes, B., Laerdahl, J. K., Lien, S., Moen, T., Berg, P., Hindar, K., Davidson, W. S., Koop, B. F., Adzhubei, A., Hoyheim, B., 2007. An extensive resource of single nucleotide polymorphism markers associated with Atlantic salmon (*Salmo salar*) expressed sequences. Aquaculture. 265, 82-90.

He C, Chen L, Simmons M, Li P, Kim S, Liu Z J: Putative SNP discovery in interspecific hybrids of catfish by comparative EST analysis. *Anim Genet* 2003, 34(6):445-448.

Heaton, M. P., Harhay, G. P., Bennett, G. L., Stone, R. T., Grosse, W. M., Casas, E., Keele, J. W., Smith, T. P., Chitko-McKown, C. G., Laegreid, W. W., 2002. Selection and use of SNP markers for animal identification and paternity analysis in U.S. beef cattle. Mamm Genome. 13, 272-281.

Herlin, M., Taggart, J. B., McAndrew, B. J., Penman, D. J., 2007. Parentage allocation in a complex situation: A large commercial Atlantic cod (*Gadus morhua*) mass spawning tank. Aquaculture. 272S1, S195-S203.

Herlin, M., Delghandi, M., Wesmajervi, M., Taggart, J. B., McAndrew, B. J., Penman, D. J., 2008. Analysis of the parental contribution to a group of fry from a single day of spawning from a commercial Atlantic cod (*Gadus morhua*) breeding tank. Aquaculture. 274, 218-224.

Herlin, M. C. G., 2007. Genetic management of Atlantic cod (*Gadus morhua* L.) hatchery populations, Institute of Aquaculture. University of Stirling, Stirling, pp. 222.

Hill, W. G., Salisbury, B. A., Webb, A. J., 2008. Parentage identification using single nucleotide polymorphism genotypes: Application to product tracing. Journal of Animal Science. 86, 2508-2517.

Higgins B, Hubert S, Simpson G, Stone C, Bowman S: Characterization of 155 EST-derived microsatellites and validation for linkage mapping. *Molecular Ecology Resources* 2009, 9(3):733-737.

Hubert S, Tarrant Bussey J, Higgins B, Curtis B A, Bowman S: Development of single nucleotide polymorphism markers for Atlantic cod (*Gadus morhua*) using expressed sequences. *Aquaculture* 2009, 296(1-2):7-14.

Hubert S, Higgins, B, Borza T and Bowman S. 2010. Development of a SNP resource and a genetic linkage map for Atlantic cod (*Gadus morhua*). BMC Genomics 11:191.

Jakobsdottir, K. B., Jorundsdottir, O. D., Skirnisdottir, S., Hjorleifsdottir, S., Hreggviosson, G. O., Danielsdottir, A. K., Pampoulie, C., 2006. Nine new polymorphic microsatellite loci for the amplification of archived otolith DNA of Atlantic cod, *Gadus morhua* L. Molecular Ecology Notes. 6, 337-339.

Johansen, S. D., Coucheron, D. H., Andreassen, M., Karlsen, B. O., Furmanek, T., Jorgensen, T. E., Emblem, A., Breines, R., Nordeide, J. T., Moum, T., Nederbragt, A. J., Stenseth, N. C., Jakobsen, K. S., 2009. Large-scale sequence analyses of Atlantic cod. New Biotechnol, 25, 263-271.

Jones, B., Walsh, D., Werner, L., Fiumera, A., 2009. Using blocks of linked single nucleotide polymorphisms as highly polymorphic genetic markers for parentage linkage. Molecular Ecology Resources. 9, 487-497.

Kijas, J. W., Townley, D., Dalrymple, B. P., Heaton, M. P., Maddox, J. F., McGrath, A., Wilson, P., Ingersoll, R. G., McCulloch, R., McWilliam, S., Tang, D., McEwan, J., Cockett, N., Oddy, V. H., Nicholas, F. W., Raadsma, H., 2009. A genome wide survey of SNP variation reveals the genetic structure of sheep breeds. PLoS One. 4, e4668.

Koski L B, Gray M W, Lang B F, Burger G: AutoFACT: an automatic functional annotation and classification tool. *BMC Bioinformatics* 2005, 6:151.

Kim H, Schmidt C J, Decker K S, Emara M G: A double-screening method to identify reliable candidate non-synonymous SNPs from chicken EST data. *Anim Genet* 2003, 34(4):249-254.

Krawczak, M., 1999. Informativity assessment for biallelic single nucleotide polymorphisms. Electrophoresis. 20, 1676-1681.

Matson, S. E., Camara, M., Eichert, W., Banks, M. A., 2008. P-LOCI: a computer program for chosing the most efficient set of loci for parentage assignment. Molecular Ecology Resources. 8, 765-768.

Matukumalli, L. K., Lawley, C. T., Schnabel, R. D., Taylor, J. F., Allan, M. F., Heaton, M. P., O'Connell, J., Moore, S. S., Smith, T. P., Sonstegard, T. S., Van Tassell, C. P., 2009. Development and characterization of a high density SNP genotyping assay for cattle. PLoS One. 4, e5350.

Miller, K. M., Le, K. D., Beacham, T. D., 2000. Development of tri- and tetranucleotide repeat microsatellite loci in Altantic cod (*Gadus morhua*). Molecular Ecology. 9, 238-239.

Moen, T., Hayes, B., Nilsen, F., Delghandi, M., Fjalestad, K. T., Fevolden, S. E., Berg, P. R., Lien, S., 2008. Identification and characterisation of novel SNP markers in Atlantic cod: evidence for directional selection. BMC Genet. 9, 18.

Moen T, Delghandi M, Wesmajervi M S, Westgaard J I, Fjalestad K T: A SNP/microsatellite genetic linkage map of the Atlantic cod (*Gadus morhua*). *Anim Genet* 2009.

Nickerson D A, Tobe V O, Taylor S L: PolyPhred: automating the detection and genotyping of single nucleotide substitutions using fluorescence-based resequencing. *Nucleic Acids Res* 1997, 25(14):2745-2751.

Ødegård, J., A.-I. Sommer and A. K. Praebel. 2010. Heritability of resistance to viral nervous necrosis in Atlantic cod (*Gadus morhua* L.). Aquaculture, 300:59-64.

O'Reilly, P. T., Canino, M. F., Bailey, K. M., Bentzen, P., 2000. Isolation of twenty low stutter di- and tetranucleotide microsatellites for population analyses of walleye pollock and other gadoids. Journal of Fish Biology. 56, 1074-1086.

Palermo M, Marazzi M G, Hughes B A, Stewart P M, Clayton P T, Shackleton C H L: Human delta4-3-oxosteroid 5beta-reductase (AKR1D1) deficiency and steroid metabolism. *Steroids* 2008, 73:417-423.

Peichel, C. L., Ross, J. A., Matson, C. K., Dickson, M., Grimwood, J., Schmutz, J., Myers, R. M., Mori, S., Schluter, D., Kingsley, D. M., 2004. The Master Sex-Determination Locus in Threespine Sticklebacks is on a Nascent Y Chromosome. Curr Biol. 14, 1416-1424.

Penman, D. J., Piferrer, F., 2008. Fish Gonadogenesis. Part 1: Genetic and Environmental Mechanisms of Sex Determination. Rev. Fish. Sci. 16:1, 16-34.

Pogson G H, Mesa K A, Boutilier R G: Genetic population structure and gene flow in the Atlantic cod *Gadus morhua*: a comparison of allozyme and nuclear RFLP loci. Genetics 1995, 139:375-385.

Quilang, J., Wang, S., Li, P., Abernathy, J., Peatman, E., Wang, Y., Wang, L., Shi, Y., Wallace, R., Guo, X., Liu, Z., 2007. Generation and analysis of ESTs from the eastern oyster, Crassostrea virginia Gmelin and identification of microsatellite and SNP markers. BMC Genomics. 8.

Rengmark, A. H., Slettan, A., Skaala, O., Lie, O., Lingaas, F., 2006. Genetic variability in wild and farmed Atlantic slamon (*Salmo salar*) strains estimated by SNP and microsatellites. Aquaculture. 253, 229-237.

Rise M L, Hall J, Rise M, Hori T, Gamperl A K, Kimball J, Hubert S, Bowman S, Johnson S C: Functional genomic analysis of the response of Atlantic cod (*Gadus morhua*) spleen to the viral mimic polyriboinosinic polyribocytidylic acid (pIC). *Dev Comp Immunol* 2008, 32(8):916-931.

Rohrer, G. A., Freking, B. A., Normeman, D., 2007. Single nucleotide polymorphisms for pig identification and parentage exclusion. Animal Genetics. 38.

Rose G A: Cod: The ecological history of the North Atlantic fisheries: Breakwater Books, St. John's, Newfoundland; 2007

Rosenlund, G., Skretting, M., 2006. Worldwide status and perspective on gadoid aquaculture. ICES Journal of Marine Science. 63, 194-197.

Rousset F: GenePop '007: a complete reimplementation of the GenePop software for windows and Linux. *Molecular Ecology Notes* 2008, 8:103-106.

Ruzzante D E, Taggart C T, Cook D, Goddard S: Genetic differentiation between inshore and offshore Atlantic cod (*Gadus morhua*) off Newfoundland: Microsatellite DNA variation and antifreeze level. *Canadian Journal of Fisheries and Aquatic Sciences* 1996, 53:634-645.

Ryynanen H J, Primmer C R: Single nucleotide polymorphism (SNP) discovery in duplicated genomes: intron-primed exon-crossing (IPEC) as a strategy for avoiding amplification of duplicated loci in Atlantic salmon (*Salmo salar*) and other salmonid fishes. *BMC Genomics* 2006, 7:192

Simoes M, Bahia D, Zerlotini A, Torres K, Artiguenave F, Neshich G, Kuser P, Oliveira G: Single nucleotide polymorphisms identification in expressed genes of *Schistosoma mansoni*. *Mol Biochem Parasitol* 2007, 154(2):134-140.

Smith C T, Elfstrom C M, Seeb L W, Seeb J E: Use of sequence data from rainbow trout and Atlantic salmon for SNP detection in Pacific salmon. *Molecular Ecology* 2005, 14:4193-4203.

Snelling, W. M., Casas, E., Stone, R. T., Keele, J. W., Harhay, G. P., Bennett, G. L., Smith, T. P., 2005. Linkage mapping bovine EST-based SNP. BMC Genomics. 6, 74.

Spigler R B, Lewers K S, Main D S, Ashman T-L: Genetic mapping of sex determination in a wild strawberry, *Fragaria virginiana*, reveals earliest form of sex chromosome. *Heredity* 2008, 101:507-517.

Stickney H L, Schmutz J, Woods I G, Holtzer C C, Dickson M C, Kelly P D, Myers R M, Talbot W S: Rapid mapping of zebrafish mutations with SNPs and oligonucleotide microarrays. *Genome Res* 2002, 12(12):1929-1934.

Symonds, J., Garber, A., Puvanendran, V., Robinson, A., Neil, S., Trippel, E., Walker, S., Boyce, D., Gamperl, K., Lush, L., Nardi, G., Powell, F., Walsh, A., Bowman, S., 2007. Family-based Atlantic cod (*Gadus morhua*) broodstock development. Bulletin of the Aquaculture Association of Canada. 105, 39-46.

Tani N, Takahashi T, Iwata H, Mukai Y, Ujino-Ihara T, Matsumoto A, Yoshimura K, Yoshimaru H, Murai M, Nagasaka K et al: A consensus linkage map for Sugi (*Cryptomeria japonica*) from two pedigrees, based on microsatellites and expressed sequence tags. *Genetics* 2003, 165:1551-1568.

Van Ooijen J W: JoinMap 4, Software for the calculation of genetic linkage maps in experimental populations. In.: Kyazma, B. V. Wageningen, Netherlands; 2006.

Wang, S., Sha, Z., Sonstegard, T. S., Liu, H., Xu, P., Somridhivej, B., Peatman, E., Kucuktas, H., Liu, Z., 2008. Quality assessment parameters for EST-derived SNPs from catfish. BMC Genomics. 9, 450.

Weller, J. I. 2001. Quantitative Trait Loci Analysis in Animals. CABI Publishing, New York.

Werner, F. A. O., Durstewitz, G., Habermann, F. A., Thaller, G., Kramer, W., Kollers, S., Buitkamp, J., Georges, M., Brem, G., Mosner, J., Fries, R., 2004. Detection and characterization of SNPs used for identity control and parentage testing in major European dairy breeds. Anim Genet. 35, 44-49.

Wesmajervi M, Delghandi M, Westgaard J I, Stenvik J, Fjalestad K T: Genotyping of Atlantic cod (*Gadus morhua* L.) using five microsatellite markers and a population specific single nucleotide polymorphism. *Aquaculture* 2007, 272S1:S317-S318.

Wondji C S, Hemingway J, Ranson H: Identification and analysis of single nucleotide polymorphisms (SNPs) in the mosquito *Anopheles funestus*, malaria vector. *BMC Genomics* 2007, 8:5.

Zhulidov P A, Bogdanova E A, Schcheglov A S, Vagner L L, Khaspekov G L, Kozhemyako V B, Matz M V, Meleshkevitch E, Moroz L L, Lukyanov S A et al: Simple cDNA normalization using kamchatcka crab duplex-specific nuclease. *Nucleic Acids Res* 2004, 32(3):e37.

SEQUENCE LISTING (3099 sequences)

SEQ ID NO: 1 - DNA, 121 bp, Gadus morhua
ccactctacaaaacaaaggaagcaaacaattgaccacacataccggataaaacaaccgcawttgaaatatcaaggcgggaaaaaaactaagctaccaccggctcaagctaggttacgagtt

SEQ ID NO: 2 - DNA, 121 bp, Gadus morhua
ttttcagagaaaaataaacgaaagaaaacaagttattcaaagcatatttggcatggtcgtwggctgtwagctgcttacacaagcccaggccctgcttgggttaccagtggaacagcactct

SEQ ID NO: 3 - DNA, 121 bp, Gadus morhua
atttatttatggtcttaagtgtctttaaatttctcccagtgtgtttgatgtacttgccctrcaaaagacaagacacgaaacgcacagcagcaacatacgttttgacaaacgcattgacaat

SEQ ID NO: 4 - DNA, 121 bp, Gadus morhua
aaccttaagtgtggtgtggagctccatgtctgtgagacagccctgcttgccaaagatgaargccgctttctctcccatcttcagaatcaatgctctcttctcctctaccagctgtctgtcg

SEQ ID NO: 5 - DNA, 121 bp, Gadus morhua
caagcttgctggaacgctttttgaatcaaaataagcatatttgactgtttttttttaaatygattatagaaatatatgtgcatggaggtttttgctggacccatttgaacatgagcacatg

SEQ ID NO: 6 - DNA, 121 bp, Gadus morhua
gacagaaatgtgtctgtacaggaggtgaaagacaggtgtggggagagacaggcttgggggrggggaggtccgagcagtccctacttgggcgggtctgtgttgattccatatttctccttca

SEQ ID NO: 7 - DNA, 121 bp, Gadus morhua
gtgtgtgtgtgtgtgtgtgtgtgtgtgtgtgtgtgtgtgtgtgtgtgactgacataaaatygaagtgttgatcaactaaaaaggaagtgagtgactcaggagagatatggaaaactaacgg

SEQ ID NO: 8 - DNA, 121 bp, Gadus morhua
ggataaaatatctcaatagtacctgacaatatatatttgaatgttttgaggaatttcttcmgaaagtgcagcgtaaggagyatgtacatactgtacattgtacctaaataagcatttatat

SEQ ID NO: 9 - DNA, 121 bp, Gadus morhua
acacactatcccctggttgagggatagtatatagtatttatgttataggtttgaaatcacygacacttttgcaaatgttcttgacacttggacgtaaagctgttcggtcgagtgaggatgt

SEQ ID NO: 10 - DNA, 121 bp, Gadus morhua
acatcattccggcacaacttcctggatccacttcaggtagggtgggttgccctgctctatkggtaggctgatcacttccgccacttcataggggtggttcgctcgcacgtattcggtgaga

SEQ ID NO: 11 - DNA, 121 bp, Gadus morhua
tgacggacagatgttctgcaacactattgcattaatgctgtagtaaaagctctggatacayactctatgtttgtaaaaaggctttaacaggaaagtccggcaaataaaaaaatgactatga

SEQ ID NO: 12 - DNA, 121 bp, Gadus morhua
aaacaccgtctcggtgcagcgtggttgtgcaaaacaataaaaaaaaaatccattaatgatkattcaaagtatttcagaagcatccgtataggaaagtagttatattatgaaatgtaccaaa

SEQ ID NO: 13 - DNA, 121 bp, Gadus morhua
gacttatctagttaagctgttaatgtttctgaagcaacatcctaatgagaacgattgaacmttggataggtgcatatcttgaacagtgttagcatgacagaatgctccgcaggcagacttg

SEQ ID NO: 14 - DNA, 121 bp, Gadus morhua
cacgtttatcctgtcccgaatatgcaagactcatcatgatcctcgtttataaaaacaaatrtttaagattattaagacgcccacttgcaagctgaggttctgacatcaaccctgtggaata

SEQ ID NO: 15 - DNA, 121 bp, Gadus morhua
agcaatagcaacatttccagattatacagcactgaaatggcattgcattttaaatgaaaamwcaaataactctcccgtttgttcattattgcactttgtttaatgtcaaatattgttagat

SEQ ID NO: 16 - DNA, 121 bp, Gadus morhua
ggaataaccataagggtgaaaccagacacctatcatagtaacagtgagccccaagacacamttcagcagacacacgtccaaagcattccatcaccatataaagttaaaagttccacacaaa

SEQ ID NO: 17 - DNA, 121 bp, Gadus morhua
acagattctgtttagttttgttgttagaacaagtcactttaatcgttttcaggaacatttrgtatgtgtacggacaaaaagagaaaacaaacctggatcaaaaacattgttaatatataca

SEQ ID NO: 18 - DNA, 121 bp, Gadus morhua
catctttcaatagtgcattaacacaatgtcaaagttkttatggaaatattaggacttcaakgaactaactggggccatgaaaacataaattcattagtgaaccacatgaaccagtgttatt

SEQ ID NO: 19 - DNA, 121 bp, Gadus morhua
agcactggaatgtacccaatgtgaacacaatatcttctgtaagtcatatttgcgtcctctraaggtgaccgcagccctgtgatttattccagtccaacacagcgcaaacatacaagaaaaa

SEQ ID NO: 20 - DNA, 121 bp, Gadus morhua
acacagcgcaaacatacaagaaaaaaaatggtctctctgtacggtcgtcccgtctcagatwaaacagtgktgttacggcgtcatcttgtggccaacctctgtacaacatctacagtgtcta

SEQ ID NO: 21 - DNA, 121 bp, Gadus morhua
gctcatttgattcctaaggctcttgttcttttaaatagtcctgtgaggcagcatcctatayagaccataaaatacatcttaattaaaaacccatcagatacatctatacatacacacatag

SEQ ID NO: 22 - DNA, 121 bp, Gadus morhua
cctcgccgtgtgggagtcgccacatttttcccgatagtgcatctcaaccctggaatgaatrcaatgggccacgcccgtgtttgaactaggatgacatgacacgccgatgaaacgactcatt

SEQ ID NO: 23 - DNA, 121 bp, Gadus morhua
acggaatcaaagcgtactttgaccttcatcctatgcgtatctagtacagaaactctaatamttataccctaatagccatctccccagacgctcccgtctgctggagtgaagacaaactgtt

SEQ ID NO: 24 - DNA, 121 bp, Gadus morhua
ctagctaccatgtcatgtacaacaggctgaggaattcctggaacatgtgaacgtttagtgkgtaagaagccattttagtttccccccaaaacaggtagagcagcagtgtgacaaaaacaaa

SEQ ID NO: 25 - DNA, 121 bp, Gadus morhua
tagtaaaaaattcaaaagtacactacgttaataaagcacaggccatgacctatgaacccaktgtaaactgagctgtgctttcccatttctgaacagaaatcttgtaaacatacatatgtaa

SEQ ID NO: 26 - DNA, 121 bp, Gadus morhua
gtagaaaggctttaatgtcaaataacaccgctttagtctgtctctttagtactccttgtgytgtctgactgaagtgctacatctgtatggacagcaacagctcctctgaatgaatactgca

SEQ ID NO: 27 - DNA, 121 bp, Gadus morhua
ggaggaaaacagtaaacgtacatgacagactggaataacgtagatcaacatcgagtgacakaagtagtacataatcaatatcaacacactaacgtacattatagggataaatggcaaagag

SEQ ID NO: 28 - DNA, 121 bp, Gadus morhua
tttctaagaaatatattttcaatcaaaaataaataaataaataaatcaggaaaaattattkgtgaaacaggccattgtttgtgcatatgtcagctcagaacagcattgagtttaaggaatt

SEQ ID NO: 29 - DNA, 121 bp, Gadus morhua
ctagccaccggcctcgttccaccaccactacggttggggctgttttctcttgggagtgwtwcttcgtttattgtaattcaacatctgaattggttttaaggagtcacaccgaagggcacaa

SEQ ID NO: 30 - DNA, 121 bp, Gadus morhua
gagtgtgtccatattatcccccccctccccccccttccattcatgaagtgatatttacatkacacttttcagaaaactcaagttacatcagaaaagtgtggtaataaggaaccaaacaatt

SEQ ID NO: 31 - DNA, 121 bp, Gadus morhua
gataggctgttaagactgacctatccagcatacatctcggtgagcacagccacctgtgagstcaccaggttacagcggagctttccaaacagcttggcagaagacccttatggctgagggt

SEQ ID NO: 32 - DNA, 121 bp, Gadus morhua
tcaaccttttagggaagatgttcattgcaaaatagacaatttagactggaaagattgattrttattatcttctcttccctattatggtaacatggcaaatcgatttttaacatgacctgga

SEQ ID NO: 33 - DNA, 121 bp, Gadus morhua
ccacctatggccaccagggggcgctgtggccagcaggggagcccttcaggggcgccgcttmtctcggaggttcatctcctggaagaaggcctttccaaactcgtagctgctgatcatgatg

SEQ ID NO: 34 - DNA, 121 bp, Gadus morhua
aaacgatagagtagaacccaggcgttacattatttaggcagccaacatgaagtttcggccktctctatattaacagaacatataaaacataaaaacataaatgttaagaacgtgaactgaa

SEQ ID NO: 35 - DNA, 121 bp, Gadus morhua
gtgacagttttaaaacacaacaatgtattcccataatgaaaacaattttcacgattaattrccaaacaatgacaaaatacattaataccaacattaaaactatcattacttatggtcctat

SEQ ID NO: 36 - DNA, 121 bp, Gadus morhua
gggacgagatggatacgtccttgtccgacaagtccatgtccagctgctttccctggaccaygaccttctctaagcagccgaccagaaagttgctgccgacggcgtcctcttcttcaccaag

SEQ ID NO: 37 - DNA, 121 bp, Gadus morhua
atgtccattttatgcccctcaactacgctagtccagtcagtaagttaccctcaagtgtgtyctaagcccacagaacacttttaaagataggagggttttaacccgtctaggtcaaccttat

SEQ ID NO: 38 - DNA, 121 bp, Gadus morhua
gggcttcgaacagcctcagaagactcatccatgtccccgccctcttcaaccgcttgggagktctcgtcaagaagcgaagcatgtgcatttgaaggatcaataccttgatctctttgaagct

SEQ ID NO: 39 - DNA, 121 bp, Gadus morhua
tgtttacatatattcatagatatatattagaattgtaccttacaatacataccagaatgamaacaaagcaggttagagtaactcaaaaagtaagacaaaagatttatttcattaatccgga

SEQ ID NO: 40 - DNA, 121 bp, Gadus morhua
actctactctggaggttacaggcagattgtgtacttttcggacaacaatgttgtgaakygygtgtctgtggatgatggctgcttcaagcgggctcccctgggcacgaggcagactgattag

SEQ ID NO: 41 - DNA, 121 bp, Gadus morhua
tggcaatacgcttgaattttgcgagaaacaggcgaagaactaaagaggcaacgattgctarctccttgcagcaattcttcccaaaagctcttttaccatgacaacatgtttctatggcaag

SEQ ID NO: 42 - DNA, 121 bp, Gadus morhua
acccatgagctaatgtgagcccgctgctctactggtgtgtttaggtacaggactagtggarccacttggtccgagaatacatccatccacaaagtttagtttaactggtcccagcgcaggt

SEQ ID NO: 43 - DNA, 121 bp, Gadus morhua
accacatcaaaagcatccaaaccgggtttttaaaaaaaaacgaaatctaaaagagtcagtragtggcagcgacttaatgctttcagacaacatcccaataagagaaaccraacccaaaaaa

SEQ ID NO: 44 - DNA, 121 bp, Gadus morhua
tccaaaacgaaaccgccaaagtatatggattgatacaaagaagaggggaaaaaaacaaatkagatctaatttatattaaaaatgaatgtgcaggcaggtatttgaaactaaagatgcatta

SEQ ID NO: 45 - DNA, 121 bp, Gadus morhua
gatctaaatcagttaattgaaagtcaatcgatgcagataaagtctttaaatctgctagctyaatgagcacaaaacttaaaatacagttatgaccatagctcagttcatatacagagaacag

SEQ ID NO: 46 - DNA, 121 bp, Gadus morhua
aaactacatttacaacttgccaacttaacatagaactcaaatcaaaacaatgttttcagartggtttattagtatatttctttgaactttaacagaaaacaaaaacaccatgaacactatc

SEQ ID NO: 47 - DNA, 121 bp, Gadus morhua
aggcagcgccccctctggcgacacgacgccaattcacctaaaagcagggccaggtcgccgktacagaaggaaccgtcatgaccagtttgacaagtttgaccagcgccgtgctccccattaa

SEQ ID NO: 48 - DNA, 121 bp, Gadus morhua
gcgctactcgaagctcaagaagattgagcactggctaacctgtatctagataaatcgtagrgaatcacaaacgttccttgagattgtacttacataccatccacatagtaaacaataaata

SEQ ID NO: 49 - DNA, 121 bp, Gadus morhua
agattgtacttacataccatccacatagtaaacaataaatataacaaactaactaaaatcktactgttttaattgtgacagcccatgtcattacgaawgtggtatagatattcttcaagac

SEQ ID NO: 50 - DNA, 121 bp, Gadus morhua
taaagaaaaggcctggatgaaacttacagcactgctagtcctcagcaccaggtcttccttytatataatctattctttcattcatatattaatatcccattcataaaataaaagcagccgc

SEQ ID NO: 51 - DNA, 121 bp, Gadus morhua
aaaacataacctgttacccaaaaaatgcatcactttttgaataaaataatgacaaatggaratccttcttggctgaacggacctaaacattctttgtgtgctttcggtctctgaaatcctc

SEQ ID NO: 52 - DNA, 121 bp, Gadus morhua
acatcttagggaaaaaaactatttaacaaatcaatgaatggaatcaatagatggctaatcsgcatttgtggacacacgcwatttaaagtgygtgagccggttgcattggctggtttacagt

SEQ ID NO: 53 - DNA, 121 bp, Gadus morhua
gatatacataaaacaagattagggaaacaagggtaaaagataattagcacgcagtgaatayaatggcaagccatcctaaatagcattcaccttgtcataatgacaggtatgatacaacgta

SEQ ID NO: 54 - DNA, 121 bp, Gadus morhua
aaagtgccagctgaacagaaaaaataagacaatgttcctgtgactaaaagcagtatgtatwttttcttttaaggtcttacatttgataaaaaagaatgtgcatttaattcaatggaggaaa

SEQ ID NO: 55 - DNA, 121 bp, Gadus morhua
acaaataagaaattggtagaactttgctttgcactccaaagatattcaaaggctaaaaagygataaagtaatacttaaaaagatgatgaaacgaaggtgtcacaataggcgcacaacatga

SEQ ID NO: 56 - DNA, 121 bp, Gadus morhua
tctagcaagacttgttgaacttgaaaagaccagccggtctatgagagtctacgacatcctractcataagtgtcttcatgataccgatctcccgcgaagcatcgaagcattcatacgtccc

SEQ ID NO: 57 - DNA, 121 bp, Gadus morhua
taaatatatccctgtacttagcctttgtgctgacatttgatcacaccaagaaaaatttaartagaacaaaaataactcacgagttgaagtcaatataatagatatttgttagcatgtgtat

SEQ ID NO: 58 - DNA, 121 bp, Gadus morhua
actgatatggacacagtacatgtgaacaccacagagaagtcgaacagtgggagtttatttrttgaacagtaactttgtgttccytcatggacgcggaggacggacaggaggttgaaaggga

SEQ ID NO: 59 - DNA, 121 bp, Gadus morhua
ttgagatgcaaaatatggagaacaatgtcaactgaccagataaaacaaaagtatttatggrataaaactactgcaatccccacaagaataacagagaaagtggtccaatgttgcatgcaat

SEQ ID NO: 60 - DNA, 121 bp, Gadus morhua
ctctccccctgctccaggagggagaaccataatatcaatatcaccagaatcttcacttttytaatatcatgtgcaatattacgtttccattttgcttttctgttttttgttaacttattat

SEQ ID NO: 61 - DNA, 121 bp, Gadus morhua
tctaacaagcatcaatgtgatttcttagacagacatcacacatatcttttacatacactcwgcaaactgcaaataccgaaggaaaacaacaacatagaaaaaatatgttgtccaacataat

SEQ ID NO: 62 - DNA, 121 bp, Gadus morhua
gtgaatcttctggcggccagggaacttgaacttggctctgcggagagcttcaaccacatgytccttgttgctggccttggtgcgcacagacatgatgacctgtccgatgcgaacgcgagcc

SEQ ID NO: 63 - DNA, 121 bp, Gadus morhua
tgaaatactcactaatacttatgctttcatggaaagatatcatacacacatatagaagtgyacgtataattgcgtataagtgcgcaactgaaacatgacagtcttatataaatccacaatg

SEQ ID NO: 64 - DNA, 121 bp, Gadus morhua
tcgatatttctatcgattccatgggcaggggcgagcagcattgtagygatacaatgcstaktgtaggtcagctaatatgacaaaggggataaggttggcccggttttctcaatcgcttcct

SEQ ID NO: 65 - DNA, 121 bp, Gadus morhua
cctcatcaggagcccgccgtacgagacgtatgccgagaggcgtgtggctgcttccgtggargtctcgtctccctcgatcttataaacctttccatacattacgtagtcaaactggtctgct

SEQ ID NO: 66 - DNA, 121 bp, Gadus morhua
tttcttaaaatcggctcaatgtttgacgtaaacgtaatccatttctgttgactgtatgtgyaaatatcaacacagagcaaatctgcagaagcttgtatttccaacaccgttgcccaaggtc

SEQ ID NO: 67 - DNA, 121 bp, Gadus morhua
ctttcagtagccctttcacagtgcagagggacgttacacctagacgaccagacaaatgcarcaccatctcaatggcttgactttgtctccacagtatttaattgagccatggttagttaaa

SEQ ID NO: 68 - DNA, 121 bp, Gadus morhua
tgaagtctcttcctctgcctctccaggtgagccttcgtttcctggagaggattgagtgaamccgggacattaggctgtgtttgcggcgagtttgtgatacgtatatgaagcgaaaaaacgt

SEQ ID NO: 69 - DNA, 121 bp, Gadus morhua
atgtccgtagccgaagaagaactagcttgaaggctaacgctaaaaatagcaggaggcaggytgtgttcaccttatctagatgttcttggcattttctgcacctaaatatcactgtaatagt

SEQ ID NO: 70 - DNA, 121 bp, Gadus morhua
gaagagcactgtgatgttagatgagctgtgatgcgagacgtatatcgggaaaatggagctrgtcccaaaggaatgtcgattaatcatcgaggaagaagtagttcccactcttcttttgctc

SEQ ID NO: 71 - DNA, 121 bp, Gadus morhua
gactatttaccctctttaattcaatacagcagavaccttgaattttgcagaacttaaaatkaccctcactcttctcttgcatggccagtatgttcactcctcttgcagtacagcagtcacc

SEQ ID NO: 72 - DNA, 121 bp, Gadus morhua
taacagactggtcgctaatgccgcggagcacctaagcagcatatgctacaaaatgattgamaataaatccaaataaaaataataagctaacccaggagttaaatacagaaaaaaggctaaa

SEQ ID NO: 73 - DNA, 121 bp, Gadus morhua
aaaatatgcaaataccatcggaaataatcaaaagaaaaatgggcaattgagttacatttgrgttttatgtttcatgttcaataagtagagttaacatttaaagatggttacctggagtgta

SEQ ID NO: 74 - DNA, 121 bp, Gadus morhua
cggcatggattaagattaagaaaaggatacacatcgacgcactggtaaaaatgaaatgtcmaatgattatttacattaaagactaatccacaacacttgaaaaggagttacattttttaat

SEQ ID NO: 75 - DNA, 121 bp, Gadus morhua
gaccagtgtgtagatcagaatggcggcttgccgtgtgattgccacaggaagccaaaaggcrcacagcccgtaacatctgaccccttcacatttggatcggtttgtctacatagctcattaa

SEQ ID NO: 76 - DNA, 121 bp, Gadus morhua
acgtccaacaatgttgtgtaccatttagaagctgttgacgttttgaaagatctccgsccgsctccagccatgtcctgaaggcaggccaggcccttgtctctagatctggtttcttatcctt

SEQ ID NO: 77 - DNA, 121 bp, Gadus morhua
acacgctttccgcggtggcgaccagtgaggagaatgaccacggttccaggggagatggackggcgcagcttcctcttgtgctggctgaagggcttaatcccgtggctcttcagtttgcggg

SEQ ID NO: 78 - DNA, 121 bp, Gadus morhua
cacagcggcacaacatttagacgaaggacacacacacaacggatggagtcgggtgacaccwttaacacagtcacggatcgaaatgccagaggtgatatgatgttcctttgcactccacctt

SEQ ID NO: 79 - DNA, 121 bp, Gadus morhua
aagaactatccctgaagaacagattaagccgttttacataaatgttcgtaatagtaaaaaraaaaaaaaattgggcaaccaggtctttacccctctggtgaaactgcaaccgtgctttctg

SEQ ID NO: 80 - DNA, 121 bp, Gadus morhua
taaaattaaatatcaatgctcgaaaattaagaaacatcttgaagcctaacagtatcaaacmaacccaacgagatatattacaacattctgttagcaataacttatttcacatcatgcaata

SEQ ID NO: 81 - DNA, 121 bp, Gadus morhua
caaagtttgggtcgcgaaaacaagttacacaaaatggacatgggtgtaatttgcgatgcaracaataaggcacgtgcgccgccattacatgtttgatgactcgggacaagcttctggactc

SEQ ID NO: 82 - DNA, 121 bp, Gadus morhua
tacttcgtagaaggggcccaagacaatggctagacttgtaagacatttatttttcttttgyctcaggttgtttaaatcacttgcaaccacataatgcatttactattactttgttcctctt

SEQ ID NO: 83 - DNA, 121 bp, Gadus morhua
acgatcgcaatactggacgactttggatgcaaatatcctgaaagaaaaacatcctgtgtakgtttacaattttttctgatggtcctgatccaactggtaatgaatgacaaccaataaatcc

SEQ ID NO: 84 - DNA, 121 bp, Gadus morhua
caactttttttgatcagggcagttctcaaagaaggcagatccatccagtgtttgtgtgtcwgcagccacttccagcacacaatgatgttcgggtcattttcaaagccgttcatccagttct

SEQ ID NO: 85 - DNA, 121 bp, Gadus morhua
tttttctttggcccctctgactctcaccaaccttataggtcatatcggccgtgttgaaacrgaccccccaagtggtctgaggaaggcgctcgtccacactgcactttgaggggtttgtaca

SEQ ID NO: 86 - DNA, 121 bp, Gadus morhua
caaaacggttgtgattggttggtcaatatggtaccgggaagaaatctttattgtattagargcgagccagaactcggcagtgcaaattaaccatgagcttgcgagagttgtctggttccca

SEQ ID NO: 87 - DNA, 121 bp, Gadus morhua
aaacatggctttgagcaaagtaaatctcggaaaaatgaggaagcatgcttcaacattgggkgttgaacccgaaaaagcatgcgatgcaccctaaatgatatttacaatacaattcatgtat

SEQ ID NO: 88 - DNA, 121 bp, Gadus morhua
ggacaagaccgacagagtattgtccttaatggttcctcagccggaacacccactaacccamaccccccgtttatttttttttaaccaaattggtcttgaaataagcactacaagattttct

SEQ ID NO: 89 - DNA, 121 bp, Gadus morhua
accattctgtccaatgagcgtttgtccctttaacagtagctggctgggtgctggggttacrgctggttgagaaggctgtgcttctgtgctttttactcctccgtccacactccagatttta

SEQ ID NO: 90 - DNA, 121 bp, Gadus morhua
tatgttccctgcttcgatccgctaagcagatgtaattcagaaccccatttgtgtacaagaygtaacagtataaaagtgtcctacacagcattgagggcattgctggcctttcaaggtaaat

SEQ ID NO: 91 - DNA, 121 bp, Gadus morhua
gaacaatggatggcttctaggtttcagaacaaaagctatcttcataactgaatgttctttyattttgatgagtaaagccaagacaaaatcaagaaaaatcgacattgaaaaaaaacgtcag

SEQ ID NO: 92 - DNA, 121 bp, Gadus morhua
cacagtataatacaccgtggaatcccagccttccttcagccacgcagagttccttgtctcytcgcgggactgcaggtctttgtacgcccacaaatgatgaaccacgtagaggtctccaatc

SEQ ID NO: 93 - DNA, 121 bp, Gadus morhua
tattacatcgtacgtggacacagggttcgccatattttatttgaatcaacttctatattcyggcccttgacaggtcctctaacaacacgacattaagcaaatacattaggtaagaaattat

SEQ ID NO: 94 - DNA, 121 bp, Gadus morhua
tgcaaaacctttcattgtattacatttaggaaaatgtcccctttgtgataattaggctgtwtgaggttatccctgcctcgttaatgacttagcccatgagcaagtcaagtcatatgatttg

SEQ ID NO: 95 - DNA, 121 bp, Gadus morhua
taaaaggtgtcttatcagggkttctttacctttcaaacacacacaaccacaaggcctttaraaacaaaatacaaaataacattcttagccatacaagaccggaaatacagagttcaggcta

SEQ ID NO: 96 - DNA, 121 bp, Gadus morhua
gtgctgctcacatgtcaacggtccaccagaatcaccctgacacgagtccacgcctccctgmaggtagccagcgcagaacatgctggggccaacaggatgagctatatactggggggctgga

SEQ ID NO: 97 - DNA, 121 bp, Gadus morhua
cacggaaaagcttcgggaaaggccggcctaaccaagaccataaagcgacgtacgtcmctgytggacctctgagatgtcccaggtgaagttcagctgcaggtccttcattctttcgttgtag

SEQ ID NO: 98 - DNA, 121 bp, Gadus morhua
tgtgctaatgtgttacaagatgggaagtcttcaatgtaggcctcatatcttcaamaccggygttcctactgtgctgaactgtacccctgccaacataattaatttgtatcttaaatgcaca

SEQ ID NO: 99 - DNA, 121 bp, Gadus morhua
aaattaaaatgtatttatttctttaagtttttcacaatgtactgaacctctagattaaaamcaaaaaaatactttaaactgaaggggaaaagaaaaaactagtttagaaaagaaaagtgta

SEQ ID NO: 100 - DNA, 121 bp, Gadus morhua
tatgatttatattagaatttacaaaaatcaaccatacactcaaatttgtataatccttctktcattaaacaaataagctaatttattctaaaaaaaattccttcttgaatagctgtaataa

SEQ ID NO: 101 - DNA, 121 bp, Gadus morhua
agtcttgggcaaataacaactcaactttagtatataatagatttagtccagtgtttcaatmatttcagacctattcattctttaacatggccaaagactggggttgaaaataaatgttatg

SEQ ID NO: 102 - DNA, 121 bp, Gadus morhua
gaaaatacactccgtttaccgacagaggaaatcatttccactaacgcgagtggtatgataygagagctgctattgactttttttcggatcatcttttatgggttcgagatgaagactgaaa

SEQ ID NO: 103 - DNA, 121 bp, Gadus morhua
cattaaaatagtatgtttttaattgcagttaggggatgagatgtagagctttctgccctcygcgaatactagttagtgaagggtttgtattcaaggtgtagcctactaatcatttgaacca

SEQ ID NO: 104 - DNA, 121 bp, Gadus morhua
tgaatacgtaccatcaaaactaatgtgctactctgcacgtggtatgatgttaaatgagagrgccggcaggcaaattgaacaatatgtctgtagcatgtcaagtgttatttgatctttgcaa

SEQ ID NO: 105 - DNA, 121 bp, Gadus morhua
gctctatagtttcagacacatacaataaacatagatcctcagataagcaaagtaaagtcaktcaacaagcacttgatttaaaaaaataaagtacaactttgcttgcataggacttcctttc

SEQ ID NO: 106 - DNA, 121 bp, Gadus morhua
gcaatgttcatatgtccccatatcgtaacgaaaacaacaaatcaccttactggacctttaytgatatttattcataaaccgatggttgaataataaacatcttgcataaactaactgcgtt

SEQ ID NO: 107 - DNA, 121 bp, Gadus morhua
atacatacgtgcaggtgaagccaagtaaatcagaaataaccaaggttcaactgccggtatsggagttcacaacatccaatcggtccaacgttgggggcatgaaaggacaacaaatcataaa

SEQ ID NO: 108 - DNA, 121 bp, Gadus morhua
ccacaacttgtgtgcacactaaacaaacgaagacagcacggcactcggaagctcaggctamtacgctgtgttgaagaaaaggcatttcatcgctgcaccgttcaaccaacgtgcaccgtct

SEQ ID NO: 109 - DNA, 121 bp, Gadus morhua
acagcagacacaaagtgctgctgtttctttaagttaagatcaggaggtmarccatctctakaggtatttcccacgaccttcagatgacgtgacattacgtgtacgttcgtgcaagtccaca

SEQ ID NO: 110 - DNA, 121 bp, Gadus morhua
tcctcacaggtaggaggatatacaacatgaaattaaagacaacaagcagagatcactccgyccacttcctgtgggcagaggcgcaacttccacattcccaaagtaaaagtgtatcccggtc

SEQ ID NO: 111 - DNA, 121 bp, Gadus morhua
tcaaccgtcactaaaagcgctacagcgtggtggatatccatattaacgctcaatcctatcytcagctctatagaagcaagatttagtcaacagcgagaacaacaagtctggctgaagttct

SEQ ID NO: 112 - DNA, 121 bp, Gadus morhua
gccaatgaaaggcgagatgctctcgtctcaagtctttaagatgcatcaaaggcccctcccygtmgaaccattggacgtaaagcaacatccaaacaaaacctagtacactaaactaagaccc

SEQ ID NO: 113 - DNA, 121 bp, Gadus morhua
ttctgaaaggaataggcctctcgtctggagttggtccaaccaccgaagccgtgtttggaartctagacgttggcgttgatgatctcaacaaactcggccttaagggaagctccgcccacga

SEQ ID NO: 114 - DNA, 121 bp, Gadus morhua
tcaactgcgcctgaaatctcctgaaggagttaatgaagttattaatgttgacaggtcaacmtaaaggtgaagtgcagaaaaagtgtgtcgtaattgatcgacagttaattaacccaagaga

SEQ ID NO: 115 - DNA, 121 bp, Gadus morhua
cacaaaacaagaacccatacccaatggcacagagaagcatgacaactggtacgttattggwtatcatttcaaagcaatatttgtgtttttcattccagagcaaaaatgacaagaacggcat

SEQ ID NO: 116 - DNA, 121 bp, Gadus morhua
cagaaaagatgtgtgctgctgtctaattgagctatattacaacatcctcaaaacagacagscaaaacatcacaatattatctcaagaaagttcagtctaacttgataaattaacttgtacg

SEQ ID NO: 117 - DNA, 121 bp, Gadus morhua
ttgaccaattaggctaatgtagacatgaacattagatcgcatacagcactggctgattcascacagggaaacagggggtaggaagaagaactacatcaatggatcaacttagtgggctgta

SEQ ID NO: 118 - DNA, 121 bp, Gadus morhua
ataaaaacttgcgttcgtcttgagtcctataaacagttagccatcgtcttcctcctcatckcccccaaatgacagaagactgttatttttcacttttctctccttcttgtcctccttcttg

SEQ ID NO: 119 - DNA, 121 bp, Gadus morhua
ggaaccaggctcgagtaacagtcagacaatggaaaaatcaagaaagcaagcaaacaaaaaraagaacaagacgaacagactcgtttttttggcaaagcagaagaaaaagtgacaggagaag

SEQ ID NO: 120 - DNA, 121 bp, Gadus morhua
ccagtaccccagtggcgagstgaggggcttcccgaacacatactgcaggtcgtcagcgtgrtccgctcccatccagctggggtagggcagcaccagaccccccatgcggttgggctgggag

SEQ ID NO: 121 - DNA, 121 bp, Gadus morhua
gacatctaaaataaacaattaaaaacaaatggaatgtagtaatagatgaaaaaaagacatwaaaaaaacaagatatcggaattgaaacacgagttactgcacgttgctgttgtactgccta

SEQ ID NO: 122 - DNA, 121 bp, Gadus morhua
agcaccatgcggtccacctccgtgggcctttttcctctccttgtggatcagggcaaagtcyacgttcaacctgtccgctatcgacgtgaccctcttggctccacctgcgtcaggggacacg

SEQ ID NO: 123 - DNA, 121 bp, Gadus morhua
tttacatgtgctctcaagacacacgtgttggttctgaagtgaaaatgttcactttcttttwaagattaatcgataaataaataaacaaacaaagaaaaaggtattgtaaatgccaatgtcc

SEQ ID NO: 124 - DNA, 121 bp, Gadus morhua
ctttatacaaaggagtgcaagggtctgkttgatctgtgaggccggggaacagcgggtgggstcatcattcatacatttgctgatttaagcaaagtcccttttaatcctgtttgttagggtt

SEQ ID NO: 125 - DNA, 121 bp, Gadus morhua
cccagggctagggatagggttagggttagggctagggctagggttacggttcacagcccakggctcttctgtccagttctctcctctctccagtgtgcgatgacggcaacraaatgtaaac

SEQ ID NO: 126 - DNA, 121 bp, Gadus morhua
tcattaatccttttttagaatrtgtgccatttttatctatagacccagccggcgtccaccmtgatgaaaatgtgtcattattttctccacatcacaagtggtgtgtctttatccgattcat

SEQ ID NO: 127 - DNA, 121 bp, Gadus morhua
ccagaaagctcttataagggtagggtggcgggcagattaatgaggrctttgcctttttggyatttcggacatggcctaggcttgttgaatggccttgtttgttgtttatttgtgccatcat

SEQ ID NO: 128 - DNA, 121 bp, Gadus morhua
atcaagtcgtctcgtctacactagctatgaggacaggtccgtcattaccacaccttccaaytttgtcccgactacagaagaggaaaaggacggtttcattcatgtgtttatagcgacgtta

SEQ ID NO: 129 - DNA, 121 bp, Gadus morhua
tcctgtagagaagccgcttcagtctggtgcattcactgtcggtcgagtgagaactcttccrcctccacttgtcccggaacgttctctagtaaatgaagagcacccgtgtccgaggcagagt

SEQ ID NO: 130 - DNA, 121 bp, Gadus morhua
ggactttaatcttattttacttccttgttcacaggtagaattacaataaggcgattgaggyacataaggcattaattatatacaagagctacgttgagtgtttaagaaaaagattcaatca

SEQ ID NO: 131 - DNA, 121 bp, Gadus morhua
atcaatcatgatgtgcttgttcctgaagaagaacatgaccgtgcacgggtcgtacaactcrtacatcttgttgaagtcgggcacctctgtgatgtccaccaagtaaatcacttgcaaagtt

SEQ ID NO: 132 - DNA, 121 bp, Gadus morhua
cctgctggcaaacaggaagtcatttacatcattacatctctcactttacatttcagtgacrcaacctcttaagctatataccacacgcaacagagtgaatgctaattctcagtagtgttac

SEQ ID NO: 133 - DNA, 121 bp, Gadus morhua
tatcactctattctcttggtcaacagctggttggtgattgaaaagtccctccagtgacgtsggtgcaggttcttcaaatgttgacatctctgacgttgacttgaagtgcatgttaaaaaat

SEQ ID NO: 134 - DNA, 121 bp, Gadus morhua
aatatttattttaatatctacttggtagaacaggaatgtagtacttgattgacttgaaaaygtgtaaaaatgtgtgcccgttaaaacagacatttgtgtcacataagggtaaaaaacataa

SEQ ID NO: 135 - DNA, 121 bp, Gadus morhua
caagattatacaccatataaatagaaaacacactcatacaaacaaacaggagatggggcargccccttacgtacacaggctggtgtgtttgtgaaagaaggaacagaaagacagtaaacaa

SEQ ID NO: 136 - DNA, 121 bp, Gadus morhua
gtgtttcagctgctgtgtgagtgcctgaccattgtcgtcgccgggaagatggggaagaaawtgagcccggagatgcaggctgcgtggcagaagtacctgtgcgcggtggtttccgccctgg

SEQ ID NO: 137 - DNA, 121 bp, Gadus morhua
ttcagcctaagctacattgaacccttaagacwacgccacaatggttgaatggacagctgcygagcggaggcacgtcgaggcggtctggagcaagatcgacattgatgtctgcggaccactc

SEQ ID NO: 138 - DNA, 121 bp, Gadus morhua
tgggttgtgtctgcgcaggtgcgtggagacaaacctacatgtttatgcgtgyatgcgagtwggcctatatgcttgcaggtgcgcttgtgtgtcgagaaaaaacgatatagcgagacaaact

SEQ ID NO: 139 - DNA, 121 bp, Gadus morhua
catcttctccaacttggactacgaagagatcggccgcaagtctctgtgcaggtmtgcaccygaatattgccccatatgtcgttaagaatgcattgtgaaactaaaactcgtatttattttt

SEQ ID NO: 140 - DNA, 121 bp, Gadus morhua
gatcgccgcccatggcaccaagatcctgcacggtctggaccgggccctgaagaacatggaygacatcaagaacacctacgccgagytgtctctgctccactctgacaagctgcacgtrgat

SEQ ID NO: 141 - DNA, 121 bp, Gadus morhua
catcaagaacacctacgccgagytgtctctgctccactctgacaagctgcacgtrgatccmgacaacttcagggtacgatcatgcacgaaccatcgccagttattctcacctcrcggtgct

SEQ ID NO: 142 - DNA, 110 bp, Gadus morhua
cttcaccgtggakacscaggtggcgtggcagaagttcctgtctgtcgtcgtctccgctctsggcagacartaccactaagctgatattcaacaaaatgcagattttcttg

SEQ ID NO: 143 - DNA, 121 bp, Gadus morhua
tcacggcgcttcagagggatcccagttataacttgagcacccaagcagcctgtggatcctrctttcattggttgaggaagtgttttccaaagcagttgtgtctgttacggacagcaggacc

SEQ ID NO: 144 - DNA, 121 bp, Gadus morhua
gacaacatcacctgctccctggcggcgggacagctgcagatccacgccccccgcgagagtrtcggcgatgggaaggagagagtggtgcccatccagttcaccccggccatcacgtcctcac

SEQ ID NO: 145 - DNA, 121 bp, Gadus morhua
tggcagcgacagtttctttaaaattacttcaatgaaggagaagagatcaggcscaatgtgwtgcataattcaggatccctctccttcatactatcaatcattatctgacttgctctctccc

SEQ ID NO: 146 - DNA, 121 bp, Gadus morhua
atctgacttgctctctcccctttccccatcaccaggtcgatcagacaacgtgcttggtctkctytgatcttgtggttctccatcacagtgtccttgtcctcagtactgaacaccttctgct

SEQ ID NO: 147 - DNA, 121 bp, Gadus morhua
cttggtatgatatgcataatctgcacaccaacgtcaatatgatgaatacatatgtgtagaraaaatattaattaccttttttttatattgtggcacaatgtactaaccgtgcatattctta

SEQ ID NO: 148 - DNA, 121 bp, Gadus morhua
gtgtgcagtggatgtacacctctttaccaactgcaaacttaaaggcctgcagggacaagcrgatctctgaggagaccacccggggttcgaatcgcgagcgcgcccccttgctgtccataag

SEQ ID NO: 149 - DNA, 121 bp, Gadus morhua
tcgcagccgtgtatcagcaaccggttccccccatcatcctttcctgaatcgctacacacamaaacgcacgctcaatatgcttatttgaaactctctctgctgtcacaaaagaatggccaga

SEQ ID NO: 150 - DNA, 121 bp, Gadus morhua
tgtcatccgtactgtttggatggatggatgaggcgctcatccctttaagtgccacctgagraacacaagccacacagattccattgagaaacattgggcaggtcagaggtcctgtttcagc

SEQ ID NO: 151 - DNA, 121 bp, Gadus morhua
atgtatctgatcatacatcatcatcatcatatcacctcaacttcgggattacaaacgctayctgtttataatgaatctcatggccatgttgtactctagagagattccattattaaactct

SEQ ID NO: 152 - DNA, 121 bp, Gadus morhua
tcggtctctggatgttatgcaagaagaggcccatgttgtagaagctatcacaacaacaacracaacgttgtttcccattacatttagtccttttaatctttggtctgtcttctctgttctt

SEQ ID NO: 153 - DNA, 121 bp, Gadus morhua
acctcctctctcaaaggtctcgactctctccggagagtcagaagcttttctacgacaacgrcggggagaaaataattctcgacgataccatgtcatctctgagtgcctatggtgtgtcacc

SEQ ID NO: 154 - DNA, 121 bp, Gadus morhua
gaccaaggacggccgcatctccatggccggcgtgacatccgggaacgtgggctacctggcrgccggcatccacgcagtcaccaagtagccgcggcgacgcagagatgaatatatatatata

SEQ ID NO: 155 - DNA, 121 bp, Gadus morhua
cctcacaactgcatccacttcttggttttctaaagagggaaaaaaaatggtgcctcttgtytcagcaaactttctatatattgtcgcaggcagcattattaaatacattaaacagctaata

SEQ ID NO: 156 - DNA, 121 bp, Gadus morhua
actgcaatgcatggagattctcagtattacatcatgtttggccctgacatctgcggctacrgcaccaaaaaggtccatgtcatcttcaactacacaggcgttaatcacctcatcaagaagg

SEQ ID NO: 157 - DNA, 121 bp, Gadus morhua
taaaggaaaacgggaaaattatgaattgcaatttcaccctgagctacataaaccaagatgytgacattcaaggctttcagttcaactgtgatgctgcaatcaaggaggcaaccctgaccag

SEQ ID NO: 158 - DNA, 121 bp, Gadus morhua
ttggccatttcaaatcaatgttttactgaagcatttatttgtattttcaatcaagagaaakaatggatgaaggataaccttacaatgtcagttaaactagttgcaatcaaatcatagatga

SEQ ID NO: 159 - DNA, 121 bp, Gadus morhua
tatcctccatattttagtgcttatgaattacactgaattggtttcaaattattatgtgtcycattgtggtcaacattgatgtagttcaggaatgttctgagtggaacaggaatgttctgat

SEQ ID NO: 160 - DNA, 121 bp, Gadus morhua
caagtcatcgttaccatcgagaactcaaacaacagcacagtcgagctctgtcttaacacasagggcttgctagccaaggcgttcatcaagtgctggaacagaatcaagaaagacgacagcc

SEQ ID NO: 161 - DNA, 121 bp, Gadus morhua
tgccaagcttctggagaatctaagggcagtgatgaagtatctttattctggaaatgatttwactaagaagcttgtggttttaatgctgcgttctctaccacttgttatgttgtgtgaggca

SEQ ID NO: 162 - DNA, 121 bp, Gadus morhua
tggcataggcctacccttcctcatggtctgttacagtagtggggaaaaaaagaaatgcacygttttgcctcacttattccagaattaattcggcccaagtcaggttcaaaatttagtaaat

SEQ ID NO: 163 - DNA, 121 bp, Gadus morhua
acatgccagcagcacagaaaggaattactaccaggcagtgaaactaacgcatccttcatcracagaacctcgaaacgtgtggaaaccctgattcatcttggagagcagaggcaagcatgcg

SEQ ID NO: 164 - DNA, 121 bp, Gadus morhua
gacattgaagtcagaacgaccaaaagtggtttagccagggcccctatcaactatgttcaakgttctcttcaacatctggaaattactgcaagaaccgctgatccagacgttttagacaaaa

SEQ ID NO: 165 - DNA, 121 bp, Gadus morhua
tatttgattggttgctttcactttggctttatagaggtgtggtcttgtaatatgatcaccractgtcgtttgcttttgttgtggttacccatatccgtgtttgaatctgactgcgtatgaa

SEQ ID NO: 166 - DNA, 121 bp, Gadus morhua
ttcacataagcatcgtctggctgatgcttcctcttgctgcctggttgcaggaatctcttartagctggtttctctgacattctgccctggaaagacttgatgttggggaactgagccagaa

SEQ ID NO: 167 - DNA, 121 bp, Gadus morhua
atgaggcgcttcaaccgagctaagagtaggaaatctctccgcattattattgccattatcsttgcatttgtagtatgctgggtcccctaccacgtgcataagtatatagaagcatatggca

SEQ ID NO: 168 - DNA, 121 bp, Gadus morhua
tttttgcattaaagatttaaagtgatgattactgtgtttgtaaaagtaactctatgaatgraatcgattcatacatctgcctcattttatccttgatactctctggcggcaatatggaatg

SEQ ID NO: 169 - DNA, 121 bp, Gadus morhua
agaatgactagaagtggtagctgtagtgagtggaggtattcaaccaatatcagggtctttytcctggaaatataaagctcatctcttttcttaagatcgctttcacatccagccattaaaa

SEQ ID NO: 170 - DNA, 121 bp, Gadus morhua
ctgtttgcgctgaacatgcccctgggcaagaaccaggcctccatgatcctcatcatgcccwattacctggagcccctggagcgcctggagaagctgctgacccgggaacaggtggacacct

SEQ ID NO: 171 - DNA, 121 bp, Gadus morhua
tcagaagtagtattaccatgaggaggcaaggtcactgagttgcttgtgtggttgtcagacwatttatgttatgttcatggtgaaatagtgccgggcactattaagctatacctattataat

SEQ ID NO: 172 - DNA, 121 bp, Gadus morhua
ttgtttgaagcaactgatcctctaatgatgtgtgatttttaattgaattcatgtttgaccyttatgtaataattgtttcattaaatgtatcttaaccatttataaaagttccatttttttg

SEQ ID NO: 173 - DNA, 121 bp, Gadus morhua
atcacttgtctggcctctatcgcctgttccaactccacaagtttgtatctgactatgcggrtgttggcagcattcgacatgacccgcactttgtccaacagaaaatggcgttcgatggcaa

SEQ ID NO: 174 - DNA, 121 bp, Gadus morhua
gtatgcattttgtagtacgccacaaatatagcgcgtccgaatgctcagtacgcattgtgtwgtacggaaaacgtttccgaatgcgtactaccgccaaagtaaaccacggagttcactacgc

SEQ ID NO: 175 - DNA, 121 bp, Gadus morhua
ccatgacagaggtccgagccaagcaggtctccgagaacaagccccaccttggcatcgactrcatgcacgctaacaccaacgacatgaagcagcaacacgtgattgagacactgattggcaa

SEQ ID NO: 176 - DNA, 121 bp, Gadus morhua
actttaaaggggaatggattgcccgctttgacccccaattgacctcaaaaggggtgttctrcctgaacgacaaccagctggtggacgtggagatgatggagggtcccaaacaccccatgag

SEQ ID NO: 177 - DNA, 121 bp, Gadus morhua
cgacaaggccgtgaaggacctggtgatcctcctgttcgagacctccctgctgtcttctggrttcacactggaggatcccgccacacacgccaaccgcatctacaggatgatcaagctgggt

SEQ ID NO: 178 - DNA, 121 bp, Gadus morhua
taataacaaaagttacataccaaacctatctggatcttcttttgttggaacataaagactytagaaggtattattgattactgctatggcttcatttttggtataacagattttcaggatt

SEQ ID NO: 179 - DNA, 121 bp, Gadus morhua
ctggcgatacgcccccagtttgttgtgctgtctgcgaagagactcttggccacagacgtgrcaaaactcatgtcttcccctcggccgtccaattccaatttctggatcatacccttgtatg

SEQ ID NO: 180 - DNA, 121 bp, Gadus morhua
ccggaactgtctgaaaaacccatattgcccattattcaaaatagaatcttggtaaatacaratgaacactggcagattgaagagaagtattcggggtttcacttttccctcgattcaaata

SEQ ID NO: 181 - DNA, 121 bp, Gadus morhua
gcatgggtgaacatgccccgtaagcagggcggcctgggccccatgaacatccccctggtgscggactcgcgccgcaccatcgccacggactacggcgtcctgaaggaggatgacggctgtg

SEQ ID NO: 182 - DNA, 121 bp, Gadus morhua
ataagcttcttcggacaggaatacaagctgaacacctggcagtctgtctgtacgtcctggratggagctaatggcctggtacaggtttggatcgatggaaagcctagtgccagacgatact

SEQ ID NO: 183 - DNA, 121 bp, Gadus morhua
gaagagtggatacatgaagacagaactgatctcggtgtctgaggtccccccatcccgtctycaggacaacatgatgcccatgtcacctgacgacttcagacacctggagcagttcgtcagt

SEQ ID NO: 184 - DNA, 121 bp, Gadus morhua
tggccaccacctgatagagtcggaagacaggagttggagatagtcattggagatgaacacrtttctttcacaacatcgaaaatcggctccttgattgacgtaaaccagtctaaagatccag

SEQ ID NO: 185 - DNA, 121 bp, Gadus morhua
tgttcgaccgggtgttggttgaacgcctggcagcagagactatgagcaaagggggtatcaygttacccgagaaggcccaaggcaaggtgctgcaggctacagtggttgcagtggggccggg

SEQ ID NO: 186 - DNA, 121 bp, Gadus morhua
ccctaggagaggccccccgcagcgtccttggtacaggccgtgaagctgacccggacgtccmgggggtagaatccttccaggacgccgtccaccaccatgtccgggaggcctgcagagagac

SEQ ID NO: 187 - DNA, 121 bp, Gadus morhua
tgaatcagagaccttagagagactgactatattgaaatatgacaagaagaaagggtgagtyacacaacttattttagcttaatcagagagaagatgaacatctttaaccccacaattgttg

SEQ ID NO: 188 - DNA, 121 bp, Gadus morhua
accatgcacatgttaatcagtgtatcatttttggtctcataaaaaaaaaatcacaagtttygaggatgaataggaggaaaataggtccctttgatttctattttgtattcacgtgtatgca

SEQ ID NO: 189 - DNA, 121 bp, Gadus morhua
agatccggaaaaactgttatggagaagagcaagatgggagtgacgttccagtctgtgacawcgtgaggaagaccaaaccccacaagaaggaactctgtgaggcctgccaacagggtatctg

SEQ ID NO: 190 - DNA, 121 bp, Gadus morhua
agccattttggaaatggtgagtgaaggagacacatatcaatatttaaaaaataaataataktattgtaatcacaattctctaatcttttaaaggcatatgaggtcaagtagaagaataaaa

SEQ ID NO: 191 - DNA, 121 bp, Gadus morhua
agttgactktccccaaattccctggcactcgtaacaatcaagtccacagtgcaggttctgrtgaacatcaaggcaccctggagtccgaaacgaaaggcatcatgtgggctataaaaaggag

SEQ ID NO: 192 - DNA, 121 bp, Gadus morhua
gggcgactttacatttagcctactctagtccatgacgatcgtacaggacacgcaacaatakcaaacaaaacagctgatccatccaagtccaactctgttgtcgaggctacttagttggttt

SEQ ID NO: 193 - DNA, 121 bp, Gadus morhua
tgacggcctcggatgtgtccacccttggattggacaaggtaggtagctgcagactggtccrtcaccttctttggcctctgaagccacttggagctgggcagctgaggagccttcttcgatc

SEQ ID NO: 194 - DNA, 121 bp, Gadus morhua
agaaaagtcatggagaataagcatttgtgccgatgcacctccatgcctacagagctgtgargggggttaccagctgtgttaccatacgtaaccacaccgctggacgaagatagttgtagta

SEQ ID NO: 195 - DNA, 121 bp, Gadus morhua
atccattttaaaataattagacttggtttacccttaaaaaaaacatcacaacacctaaagwaaaaatgttctagtttcttacacatgttgcatattggctgattatgaatcaaattgacct

SEQ ID NO: 196 - DNA, 121 bp, Gadus morhua
aggccgactatcattgcacagaagggccttacagtacagggctgcatgagctggctttggyccaaacatgatcaactgttggttaccagtttaaaacaggtggaagagcaatttctgggtg

SEQ ID NO: 197 - DNA, 121 bp, Gadus morhua
atattaaaagttttttctgaatatcatcattaaggggaaatgctttaatatcgtgtcttcrgcacacattttttacgttttctatcgtgtgagataagggaattattagtaattttcacat

SEQ ID NO: 198 - DNA, 121 bp, Gadus morhua
ccacaggcgagatccaaccaaaagaaacaaataataatcaaaaaggaaatctattgttttyactttgcttcaagaacagaataaaaattgttccttttgactcctgagcagaagggaatcg

SEQ ID NO: 199 - DNA, 121 bp, Gadus morhua
tattgatgacttatattggtttataaaagttcagacaggtgtgcaaccaagaagattagakatkccatttgtaaataatttacagaagwtgacttgcattttgttgtccaagtacgtktta

SEQ ID NO: 200 - DNA, 121 bp, Gadus morhua
gcacaattattcaaattcatggaaatttcaaggcaattgttaaccatgtcaacataaaatycactgaaggattagttggttttgctttttgaaataataaatatgtttgaaattgaaaatt

SEQ ID NO: 201 - DNA, 121 bp, Gadus morhua
gatggtacgatatgttgacctatgtattacctcattctatttcaagtttttcttaggtttrgggttacagtaaagtgtaacagattgtattgacctcaacaccgttatttatttagagact

SEQ ID NO: 202 - DNA, 121 bp, Gadus morhua
ctttatatttaccccatcatatgtgaaagacctacagcaaaatacattcttaacattaaamaaagtccctaaaagtagtgacttccatttgaacagatttcgtaattcaatgttagagaaa

SEQ ID NO: 203 - DNA, 121 bp, Gadus morhua
attttatttctcaatatcaaattttatttgtgctgagatggagccgtcaaatgatggctgraggttaggttcttagaaaataaatgycttgaatggcaggataacagrcacaggcactaat

SEQ ID NO: 204 - DNA, 121 bp, Gadus morhua
ttttcaaatcggtatttcccaaaaatgggcattgtgcaaaatgtccgcaaaagaaaaaaamttccactggttgaaaatagtccagaaaaagggttcatctcgtcattatttggctttacac

SEQ ID NO: 205 - DNA, 121 bp, Gadus morhua
attgcaatctttacggttccaaaagggagggattcctctcctgtgctccttctaatggatwttgtccacaccatttagaggtcttggaggttatatgatttaaatataacgtggggctgtg

SEQ ID NO: 206 - DNA, 121 bp, Gadus morhua
attcctcctcactctgcaagcctcttctcaatcatataatcagagatgatgctgccaccaycataatccggtttcagccactggagagtgacggaggtcttgggtgaatccttcatggtca

SEQ ID NO: 207 - DNA, 121 bp, Gadus morhua
ttaagtgtgttgtggggggggtgggggcaaacgcgtcccgattggtcactggtagcacgargatcagttgacgaagagcgagcgtgtgaattccacaaagtcgaaggccgacggcagctcc

SEQ ID NO: 208 - DNA, 121 bp, Gadus morhua
ggcagctcccgtcccttgccgtctaggtagggcttcatgtgcgacatgcagtagtctgctygttccttcgtcaggttctggtagagttcttctttggtgacgtagggcttggcctctgtgc

SEQ ID NO: 209 - DNA, 121 bp, Gadus morhua
aagtaaaacgttgaatcttgaatcggttgttgccgtttgtcttgctgttagtctttgcctractctgcagatatcggtaaccatggtttcctgctggggttggccacatctcrttgtagtt

SEQ ID NO: 210 - DNA, 121 bp, Gadus morhua
tcacactagccaaaaagtcttgttaccagaaatgtgccgtctggtgctttgatctaccacrcgtcccctggcttcacctctttcacaaagtgggatgcatccctaggactgcttttggctg

SEQ ID NO: 211 - DNA, 121 bp, Gadus morhua
agtggccattttaggctgtccagttaaactgtactgctctttctatgggtaacctagtgcyttttatgmatgttcaaatccttaatacagggtataaagtagctgttactcatacaaacgt

SEQ ID NO: 212 - DNA, 121 bp, Gadus morhua
tcattgaggatgaatatgtaattcatgggaaatgatccacctttgtacatttgcccaaggygtatgatagtcactgatcgcttggtaattgcttcaattagcaagggtccatcccttattt

SEQ ID NO: 213 - DNA, 121 bp, Gadus morhua
ttaacggagattgaaaatgtaatagttaattgctttataaagaagatgtgactgcatatgygcataaacaaagtcaataaaaaacaaattcagcacattttattctacaagatcgtaaaaa

SEQ ID NO: 214 - DNA, 121 bp, Gadus morhua
gcagagagaaaaatgaaaccaagatccagctcctaaayttcattctttaaagccagtcctyatggatgtgcaaaagcctttggactttaaacaaaaacaaaccattgaccttctgacagtt

SEQ ID NO: 215 - DNA, 121 bp, Gadus morhua
ggtttgatatgtttaagtttatcttacagatggttcagttaatgtattggggttgtattasgttgtttaagtggaatcacccaagtgatacatgggttgttgggggaaaataagttgaatt

SEQ ID NO: 216 - DNA, 121 bp, Gadus morhua
cacaggtcttcatgcataatactcttaacaaaacaacagtcgagccattccggatacctgkcaaccactgaaatgttttgagaatgtcgtcggcaaacaaccccatcctttacatacacac

SEQ ID NO: 217 - DNA, 121 bp, Gadus morhua
aactcgacacatcaattaagctcatacttcgaattctccataaactagactgttggaaacwgtactgccgagggtagatacaagtgcttgtgttctgtaagaactgttctggaggcagaac

SEQ ID NO: 218 - DNA, 121 bp, Gadus morhua
atttagcttggcatcaggttctaaaataataaaatgacaacccacaaacgatagcaacatycaattttcttacccaaatagcgttcattgacaaaactacatacaaccacaagcgattaga

SEQ ID NO: 219 - DNA, 121 bp, Gadus morhua
atagcgttcattgacaaaactacatacaaccacaagcgattagacaaataatacatcaacrctaatcaccacgtggcatcttggcacttgtgaaggagtagggcacagtggaattttcctt

SEQ ID NO: 220 - DNA, 121 bp, Gadus morhua
ttcatttgatattcctcattccttcaccataataatgatattgcgaagttaaataaaaaawattgcaaatctttcatcaacaatataataacatgttggacatgtttataaagaaccagat

SEQ ID NO: 221 - DNA, 121 bp, Gadus morhua
acgatttttaaaatgtcacattaatatagcttaaaaacccttttggatataatgtcaatcsaaaaactcaaaaaccaagattattatgtcaacacataataattagacaaaaactaaagaa

SEQ ID NO: 222 - DNA, 121 bp, Gadus morhua
gaagattaaaacagcaactcagctcgattggaaagcattccgttattgtcaaaaagggaamgctatctggaatttgtatattatcaggaaagttattatttgacataggagctaccgaata

SEQ ID NO: 223 - DNA, 121 bp, Gadus morhua
tatatttatgataaaatatgatttcatttgacgatattgtttgatgtgactaacgtgtttrgggctgtacagatgtctataaagcagtgtcgtaatgacgctgctggaataaaaggaaact

SEQ ID NO: 224 - DNA, 121 bp, Gadus morhua
tgctgtgatagtaactggtatgatgttgcaaagggggaaatagtagggatattttacctcmgttttataaaacaggttcacatctaagagaattgtggatagcccactgtacatactggtc

SEQ ID NO: 225 - DNA, 121 bp, Gadus morhua
acaaaagttgtgttcctataaatgtgtatgcactgtccgagaccctagaaaataacacgcrtcctaaaataaagctaagcttcatttttaacattttaccaacttaaatatttacatggct

SEQ ID NO: 226 - DNA, 121 bp, Gadus morhua
tgtctgtcggaagtagagccaaattaacctttttcttaggaatggtttggacctgaggcakttctgtatgttaagggatgcctgaatgctgattcgacagttggttgccatggcttcgggt

SEQ ID NO: 227 - DNA, 121 bp, Gadus morhua
gtcttacaataccgtgagtgcattcattatacattctgagcatgggtgggtcccagtaggkatttcagttcagctctgacctaaaatcaactcctacaatcatcaccagaacttgagtctc

SEQ ID NO: 228 - DNA, 121 bp, Gadus morhua
atgacatatggtattgaccctatgtatccctrattctcaattaaaaagctcaacacagtcmttaagtcgtcaatacggttaccgctagttggcattatgtatgtattagttttgtagctct

SEQ ID NO: 229 - DNA, 121 bp, Gadus morhua
agtagactagcaggcccctaggagactaggagacgcctagaggacttggagacatctaggrgactaggaggccactagaagaccagcaggtccctattgatcaaggaggctgatggaggtc

SEQ ID NO: 230 - DNA, 121 bp, Gadus morhua
aaggtatctgctgagaccagatcattgtgcaaatgtgccttgaacttggcagaaacatttytttctgcgcaaatgcatataggagaaacactgtaataacccgttcttgtagacaatggag

SEQ ID NO: 231 - DNA, 121 bp, Gadus morhua
cacattccactattagaatataacagcatgcagtataaaatgtaaatgtaaatgacccagrccatcaaactaggctataggcaaaaggggacctttttayggtgacatgaagctgacctat

SEQ ID NO: 232 - DNA, 121 bp, Gadus morhua
cttcaaaagtccaatctgtcgcgttaacaacgacctgaatttaatcaaatcagttaggagmaggcataagcatttgtcgaagatcccacttggtgtcagcacaacacataggttcactgta

SEQ ID NO: 233 - DNA, 121 bp, Gadus morhua
ttatctaaccatgcattgtgaaagcagtatcgatttctttttttcagagaggacatccgcyatcaccttcccgacagacggttcagataacggtggagacaggggctattttctgtatgtt

SEQ ID NO: 234 - DNA, 121 bp, Gadus morhua
ccattgctgattaagaggaggctgttcatcacatttcaccgcaaaaacattaaatatgtcmggaaatcacataactggcctctcgaaattcttcaagaacgaaaaaagcatgtgtttttgt

SEQ ID NO: 235 - DNA, 121 bp, Gadus morhua
tgcaccctgctgtcaatcaagtggtttatatgaacttgctatgcatgaatagtaaagcccrcctttaactacgtcagatgtaaccattggcaaactttactgtgtcgctattggctattat

SEQ ID NO: 236 - DNA, 121 bp, Gadus morhua
aagactgttaagtttcggagagtgtacacatgatgagggtgcgtttggaccatttcattaracagttgaccaactgactgcggttggtgagaggaaagggttaataggatacaaacaaaca

SEQ ID NO: 237 - DNA, 121 bp, Gadus morhua
ccaagggtgttgtcttgtccatttccgagaccgccattttgaactaggagaaacaaaacgrtggaggtggaagactgttaagtttcggagagtgtacacatgatgagggtgcgtttggacc

SEQ ID NO: 238 - DNA, 121 bp, Gadus morhua
ggaacgatttgtacacggagcacatggatggcaagcctggtgatttcaggagctcaacaaycagccgtctgttaatcgctttctgtcgccaaatattggccgaggtcggtagccagaatag

SEQ ID NO: 239 - DNA, 121 bp, Gadus morhua
tgtgtatttgtccgtcagattataatattcatattcatcgtaatacttctcttccaaattkacgatggctcaaggtttttcacggtcgacgaaactcatggcaggtttttaaaaagcggtc

SEQ ID NO: 240 - DNA, 121 bp, Gadus morhua
ctgtgtatttgtccgtcagattataatattcatattcatcgtaatacttctcttcaaattkagatggctcaaggtttttcacgtcgacgaaactcatggctggtttttaaaagcgtccgac

SEQ ID NO: 241 - DNA, 121 bp, Gadus morhua
aacaaacaccaggtacatgttccaaaaaaaataattcctccagtagggaaaaaccaagacmaatgacatttaacttccatgtcaagaaaaccaatgaataaaagcctttcagccagacagc

SEQ ID NO: 242 - DNA, 121 bp, Gadus morhua
gcagtgcatttatttcagcagctgayaagcatgaatgtgattatgatgtgttatctgaatyaattgtacgttatataacgttatatgatgggttagaaaaatagcgcgatttcccttcttg

SEQ ID NO: 243 - DNA, 121 bp, Gadus morhua
ttatatgatgggttagaaaaatagcgcgatttcccttcttgaagtgattscctctcaacrwtccggaacattccttctggagagttcagagtgatgtcatcagatctcctcgctgctgacc

SEQ ID NO: 244 - DNA, 121 bp, Gadus morhua
ggagtccgccatgaaggcctcgatctcgtccacgccacgtggcacgcaggtcaggagctcmacgccgtcccgcgtcacggcaatgtcgtcctcgatgcgcacccctccgaagccgcggaag

SEQ ID NO: 245 - DNA, 121 bp, Gadus morhua
taataaatgtctgttaaaagaccgaatgaggtaacacccagcagtgctctcttgccaggcmattattataactaagaattagttcttaattaaaggtgctataaaacatggacccagagtg

SEQ ID NO: 246 - DNA, 121 bp, Gadus morhua
ctgaaactctaatgcaaggtggttatgaatactcaacatgtcacccagttggcttcatgcraactctgacattcacattggatcttcacaagctatcggccactaagcaaccaatgtttaa

SEQ ID NO: 247 - DNA, 121 bp, Gadus morhua
cattcacattggatcttcacaagctatcggccactaagcaaccaatgtttaaggtttggtrcatcatttacaaacccacttctccttgaatcgtaatttatttcattcgatgcgcagtgag

SEQ ID NO: 248 - DNA, 121 bp, Gadus morhua
tttgtataactattcaaattgaactcatggttaagctaaagattaagaacttaaggtcagygagggtagtcagaacatttcctggtgtgtgtgcatacatgtatttatgtatgtgtgtgtg

SEQ ID NO: 249 - DNA, 121 bp, Gadus morhua
cttccagtttgaatgaaatacacatacccgtttacctttctaaatacttgaattgaagtakgctatcatcaacatgtggtcattcaaatgaaaacagtgtttgtttgtttgtgtatgacgc

SEQ ID NO: 250 - DNA, 121 bp, Gadus morhua
acaggatgatttcaaacggatgcttaatttatattcctggcctgtaacatcttaatcatcrttgcaataacagcagatggtggctagaaatcaaaacaaacctgaacgcctttcacaggag

SEQ ID NO: 251 - DNA, 121 bp, Gadus morhua
agcaacgtccataccactcctttattcacacaaatctttccttcgttgccaacgacaagartctttccttcatttcgtcatctggactgtaaagttgtagaacgtgttcctccaacacttt

SEQ ID NO: 252 - DNA, 121 bp, Gadus morhua
acccagcctctcttaagtatccatagctttagggtcactcacagaaaaaaaaaagaaggtmatttctatcaaaatgcacacatgatcacaagagtaagataaacattctcaacttacttaa

SEQ ID NO: 253 - DNA, 121 bp, Gadus morhua
ttattaaacaaagttacaaagtgcaggtttaaccagtcagcaaatattactgaaccgtacytgcatgcactgcagggactggaaatggtatgtgccggaaaagacttgacaaaactatatg

SEQ ID NO: 254 - DNA, 121 bp, Gadus morhua
aatgtaccttacagtagcatgaacatctaccgtattttcttcatattcttttagtattttmtgactcaacaatagcagcttgtaagaagaaacaatcaagccctactgtaacctgataatc

SEQ ID NO: 255 - DNA, 121 bp, Gadus morhua
tatttaataatgcgtagatagggccaaaaacaggttcacactatttcacttaaacaaatartcatgcaatgataaatgcatatgattcagatgtatacaaatctggctcatagcaatgatc

SEQ ID NO: 256 - DNA, 121 bp, Gadus morhua
aaatgccgttgagcagaaacaaggtgtcaggcagaccaagggccgcacttctgcacactgrgaacacagtgcaacaaggagcacgggtacaaaaacagagggggcatgagaaaagacctgt

SEQ ID NO: 257 - DNA, 121 bp, Gadus morhua
tgtttattcttgtgtaactaagacccccacatcatcgtactatccacagtcaatcagagtscttatttctttactcattcattgttgacaagtgaacaaagtatcttcggggtcaacaacc

SEQ ID NO: 258 - DNA, 121 bp, Gadus morhua
gggtgggatgcacggggcggatcattctgcacatgcgttaattgcgataaaaaataaatamaataaacttaaagcatgcccccggtgcgtttgacagttaacatgggggctgagaaggtgg

SEQ ID NO: 259 - DNA, 121 bp, Gadus morhua
cggagattccttctggggatcgcagcctctacgtccacaggctctcgtagaaaaggacatrccatttctaacacttccttctatcggagagctggcttcagccttatagacaacaaagtca

SEQ ID NO: 260 - DNA, 121 bp, Gadus morhua
atgaaaaccgaattggacgtgcattccatagcaaaagacaccagaccctcgcagcccatcwtcttccacacaataacagtcctgtgagcgcagttcgtgacctcgaggcagaatctcaaat

SEQ ID NO: 261 - DNA, 121 bp, Gadus morhua
cacatttattacacatcaaaatacattccccactgcatttaaatgtcctcatgatctcagktttaacagttggatatacgatttgaagacattcagcttgtcagatgggtaccaaaaatgt

SEQ ID NO: 262 - DNA, 121 bp, Gadus morhua
gaagcaattcactacattcattaatcaaatctaataaaatgtgatgatccattaacaaacrataaaaagcacaaaatataataaatcatataagtcaaatcctcaagttaaagatttgatg

SEQ ID NO: 263 - DNA, 121 bp, Gadus morhua
ataacgtggaaactattctacaaacatataaattcaaattaaatcaaattccttcatttgytagaaaatatttttctattcacaaaataacaaacagtataaaatatattcgatgaaaaat

SEQ ID NO: 264 - DNA, 121 bp, Gadus morhua
acggttaaggttatgttttcgatatccgtcaataccaagtagtatcaagaggattttaatkagagagcgtaggatgtgtcaaaaactttgactgaaaggcactaaaaggctgtgttaaaca

SEQ ID NO: 265 - DNA, 121 bp, Gadus morhua
tcttgaaaagctcttgaaatgtagtgtctgtgcgccttaatgcaacaaactacaggtgtamtctccgtcagaacctaaccaacacaatacccgtcagttgaaatagtgggatgaagctaca

SEQ ID NO: 266 - DNA, 121 bp, Gadus morhua
tctgtatttaccgttctgttcactttgaaaacctagaatatttcatactttgaaaaaaaawttctatttcattattaaaaaaacaaccagaaaacttcacattgactcacaaacaggaagt

SEQ ID NO: 267 - DNA, 121 bp, Gadus morhua
tctaaaactgaactgattcattccagtactaatgcttaagcaaaacaaaaggcagtgttaraaaaaaataaaggcacaggctaattttttttcaattaacccagtttaaacctttccaaac

SEQ ID NO: 268 - DNA, 121 bp, Gadus morhua
aaaataaaggcacaggctaattttttttcaattaacccagtttaaacctttccaaactccscaaaatgattgaatagtaataacatcattcagaaagagcaaagcgggggtgaatgggcac

SEQ ID NO: 269 - DNA, 121 bp, Gadus morhua
aattgtggttcaaaaaataatgaatgtgattggtcatctgtctctggggggtgtggtctargggggctccaggtggctgttggcactcaacactcatcggaaggccttttagtctgctccc

SEQ ID NO: 270 - DNA, 121 bp, Gadus morhua
agcattttgacctccgtgcgaacggagaggagggccggcttgagtcttccaacagagtcaygtgcactagagtctggggcccccacaaccccccttgaactagttaccatgaccaccacgc

SEQ ID NO: 271 - DNA, 121 bp, Gadus morhua
atattcagtgcatacaatgttctccctgttttataaacttgtgagctatggaagtattctyttttgttacaattttatggtgatcactggactagcsatgaatttgagtaccgttacagga

SEQ ID NO: 272 - DNA, 121 bp, Gadus morhua
aaacgaagaattacaaagaaatacaactacataacatgctattgtcttggaattggcgttktcgtctatgaatctatgtgaacagaagtgcttcttggcaggggggggaaggaagctggtc

SEQ ID NO: 273 - DNA, 121 bp, Gadus morhua
ctaataaaaaagattccccgatgctcccggttgcacttaatagacagacaggatgtctaarttccagattatttatcttcctgaagaggctcaatagatcctcattttaattacttacata

SEQ ID NO: 274 - DNA, 121 bp, Gadus morhua
acaagaactttcacatggaaagcgatgcattcatttggacagaatttcaagctgaatgacratgccatattgacatcatttttcgggaaacaagacatctggaaaacaaaacaaacaatat

SEQ ID NO: 275 - DNA, 121 bp, Gadus morhua
atcctcccatggtaacttcatacgttccaattaatagttggatctcttgcactaaaagcaktcaggtggttgaagagccatttgtccagggttttcaaaaagatcaaaaacattgaaggcc

SEQ ID NO: 276 - DNA, 121 bp, Gadus morhua
tcaaaattgttgcaatcctgtcgttgatgaaaaaaaaaagggacagaaaatgcatatcccygttgtctcaaaataccacttttaattgcttaagtgtaggtgtggtgtgcttgcacacaaa

SEQ ID NO: 277 - DNA, 121 bp, Gadus morhua
ccttttttttatttmtcggttgaaaggaacttggtagtattattacagcagaacacacatsactgaaacagctgccatttcacttaacacaggtacaggaaaaaggatgtagttcaatgtc

SEQ ID NO: 278 - DNA, 121 bp, Gadus morhua
cattattattatgctgagaagtaaactttgaacctttattcctttgcaataccagaaaatwaatttgcacccaacatggataaataccgtcaaacagcttttagaatatgcaaaagaaaaa

SEQ ID NO: 279 - DNA, 121 bp, Gadus morhua
tttgaagaactttgctttgattattgcccaccccctttaaagaaacctcaactagaaaatsaacatagaaacatttcagtatagaaaaaaataataattattaatagtctacattgattct

SEQ ID NO: 280 - DNA, 121 bp, Gadus morhua
ctccactgaagatgatgcgactgggggacagcggaggaatatgctttctctctcgctccamcccctctcaatccccctaatggggggagcgagtgattagtcatccaagaagaagtagttg

SEQ ID NO: 281 - DNA, 121 bp, Gadus morhua
ctttgagtgacgccgtcatcgtgattgatatcatacatttttattgtgaaaaaaaagctgkggttatttattaagattctaaataccatgagtacatttttcagtaaagtcacttcatgca

SEQ ID NO: 282 - DNA, 121 bp, Gadus morhua
aatactagataactcagatctaaatcgaaaccataaaaagctttgttctgaattatcaccmatattcatctgcagttcagttcacatcatataaaatgggacatgacagagggagtggcac

SEQ ID NO: 283 - DNA, 121 bp, Gadus morhua
atctattatatacttatagtcatcatcagcatcggtgtggtcgtaatgatgtcacagaacmgtccggatcagagtgggtgatcctcctcgcgctgtcaccctctcacaggcccccgtcctc

SEQ ID NO: 284 - DNA, 121 bp, Gadus morhua
ttggtgtggtcaggggcggcagggaagttgagttcttctgttgactttcctccaagagggrctggaatagcaatcgtgaagtactcgttgttgaagttgtagactgctttggctttagtgt

SEQ ID NO: 285 - DNA, 121 bp, Gadus morhua
atacccccctccccccgccccgttctttttcaacatattaatctgtacagacaccttcctmatccgttcagatgactcacagtttagtcattcacagttagtacccccaaaattctgactc

SEQ ID NO: 286 - DNA, 121 bp, Gadus morhua
ttcctgacagacaaggatgataaaaggcttcacaggatattttctcatccatccacttgtygcacatcgattggaagggtaattatatttcagagtttcagtgtctcgtaacaaggtgttg

SEQ ID NO: 287 - DNA, 121 bp, Gadus morhua
ctgctcactagtgagtgctgcagagaaccaatgcaaaactaaactgaaacaagttagcatyagcatctctggactaaagcgatggctttaatcagaggctagccgttagcaggatgaactc

SEQ ID NO: 288 - DNA, 121 bp, Gadus morhua
gacgatgttgtccacacgcaggatcatctccgccgcttcagaagcagacagcagcacctgycgcttcacctggaaggactcagtaacaccgagggtcaccatgtctcctatgatgccctgg

SEQ ID NO: 289 - DNA, 121 bp, Gadus morhua
cgtcattttcttcgttttaccagtccatatggctattgttttttctaacacacatagttcraactgctcgcatggataaataggagaaactcatgacagaggaggatgacctctctctcgg

SEQ ID NO: 290 - DNA, 121 bp, Gadus morhua
accccaaacccttcagaaaaaacctttcacccttaagacaccaggtcggaagaagaccagrtggactaaagtgtttaccccgcttcctagagcagggacatgcagcccggagatctagcag

SEQ ID NO: 291 - DNA, 121 bp, Gadus morhua
tgcagcagtgagagaacgctgaatttatttttgcacaacttttggctggccacgtgttctkcgtgcaaagacagagcagaaaaaaaaaaaaattctttcatatgatcaaaattttactgga

SEQ ID NO: 292 - DNA, 121 bp, Gadus morhua
taataaagacaaacaatcgcaaaacatgaagaaactgattgtgtgtgcctatctttacctrtgttgcgttttcctctttttttgtgtgtatctatgcgattcatacactcaatgaataacc

SEQ ID NO: 293 - DNA, 121 bp, Gadus morhua
ggattaaagacagaactgcaccgccccgtgagtcccatcactaaactgacgccttcgggcrtctagctggaccccttaagggtgcgcttgtcaaacaggtactcggccatcccgttggtag

SEQ ID NO: 294 - DNA, 121 bp, Gadus morhua
ctgggtgatgatcacttcctctcccatggtaatacggggactcttgtgggcggattctgtkaatgagttgcacgctcacgttcatcaggcctgccctacccagggactgggtttatagaca

SEQ ID NO: 295 - DNA, 121 bp, Gadus morhua
cttggcaatcgaaacctttggcaaactccttgatctctgcgtccagttcctggctcctgcsctccaaactggttgcaggggaaacccaagatgtgtaaatctttatcaggcatacttgacg

SEQ ID NO: 296 - DNA, 121 bp, Gadus morhua
cacgggtgtgacagtgtaaacacgggatagagacctagaaaacacatgcagttgacagacrtttgctaaacgcaaacagacctttgaacgtgaatcaacgccttattagaggaaacttctc

SEQ ID NO: 297 - DNA, 121 bp, Gadus morhua
atccttcttcaataagcttccagtgctagagtggatccatataactggattctgtctgccytcatcgtcaatatactgacttactattatattcaacaccattactttctctccattacag

SEQ ID NO: 298 - DNA, 121 bp, Gadus morhua
agtgctattaaaaggaaacaattgagtctgccagaaaaaggggagggactttttccatggwgttcacttacttaaaatcacctacaccaaaaggtttaaccctcaatagttgctcttaagc

SEQ ID NO: 299 - DNA, 121 bp, Gadus morhua
gtacatggactgtggctgctgcgggtacatagactgtggctgctgctggtattgtggctgygccgcgttaggctcctgatacgtgacgtcaggtttagcctctgaatttcctccaccgaag

SEQ ID NO: 300 - DNA, 121 bp, Gadus morhua
acacgacagagtccaggtaactatgaagctccaacaacgctcctatttcaagcctatttcrtgggatagtaagtgcactaaatacagaaacaaacacgcatacatacctcttgtcccatat

SEQ ID NO: 301 - DNA, 121 bp, Gadus morhua
tagcaacaatgaaagaagaaatactgcaactgtttaaccttaacattgtgttctaggttaratttagagcttgttaggctccgcaatgtccaaaatggttagcttttgtgagagccacctt

SEQ ID NO: 302 - DNA, 121 bp, Gadus morhua
tcacaaaaaagtgcttccacaagcagtacaacaagtaccacatttccatctttgggagccmaaacaaaagaatgaaatttgtcaattgtacrctgtgtttccttgaacagtaaatatacca

SEQ ID NO: 303 - DNA, 121 bp, Gadus morhua
gaaaaatgatgaaacaatgtgtaactagccctgaaatatctggtttgcggctttactgagrtgaagccaaacacagaatgacttaagttaatcacaaacatcttgtttwacattcggatgc

SEQ ID NO: 304 - DNA, 121 bp, Gadus morhua
attaacaaagttctaaaagcacgggcatattaattatgatccaagatctgatacatttgcratacaaatatagaggcatttatcagtgtatacaaatatgattaaggagtaataatttcca

SEQ ID NO: 305 - DNA, 121 bp, Gadus morhua
tcatatcaaatattgtatttatttcaaactatgacatgatgggaaggaagggacttgttcycatcagaccgggctccagaccggtaacaagtcccagcaccaacactgaacctatacaccc

SEQ ID NO: 306 - DNA, 121 bp, Gadus morhua
ttgatatttgcagaagagttctgtgcagaggataaaatgatgcaagctgatttttcaaatkaaatattccccttccagtataattcaaatgtgtaaaatataccccaaactttkcaatata

SEQ ID NO: 307 - DNA, 121 bp, Gadus morhua
aaatgcaccaccgaatccccagaacaggagcaactcgacccccaccaaaaccactttgctycgagttccggtttgtggaacgacggatgcatttggtgtcgttctaagaatagaaaataaa

SEQ ID NO: 308 - DNA, 121 bp, Gadus morhua
tcgaaaccctctactcgtcgaaccaaagggttggggcgagtattatacaaaaaggggatasatgaataacacgtgaacagacgcactctcagccttgataaggtatttggccctggctatg

SEQ ID NO: 309 - DNA, 121 bp, Gadus morhua
ctccctcttgatcatactaaacatagtttaaagatcacccacaaaaagagaattcagtgtwttttctggtgacccattaataattaactaaatcaatgaaagaaagcataaaaggcaatag

SEQ ID NO: 310 - DNA, 121 bp, Gadus morhua
aaaacaggcacttttacagcattaaatataggccactaggtatttggaagaataggtacasagatgcagtactgcaatatgcccacatgagggcagtgcaacaagttaatctacaatttcc

SEQ ID NO: 311 - DNA, 121 bp, Gadus morhua
gttgctcagcatgcacacgggcctctggaccttggccagatctcctcctggaaccacagtyggtggttggtaattgatgccaaccttgaagcctgtgggacaccagtccacaaactggatg

SEQ ID NO: 312 - DNA, 121 bp, Gadus morhua
tggtccaggcgcgcccagtgcctcggcgatggcggtggtagtagctcagcatgcacacggscctccgcaccttggccagatctcctcccggcaccacggtaggggggctaggtagttgatk

SEQ ID NO: 313 - DNA, 121 bp, Gadus morhua
gccttattgaggttcactggcacagccagttgggtttgttatatgttgtaagtgaacattrtgttctcttgagacacaggtctggttcacaggtktggacatcttagattatatcagcatt

SEQ ID NO: 314 - DNA, 121 bp, Gadus morhua
aggacaaaacggtacgataatttatttgcttaaaagagcattgaacgtaaaaagtaatgcrgaaatcatctattaacttctcccagtgaactatctctgtttttagttagtttggctttgc

SEQ ID NO: 315 - DNA, 121 bp, Gadus morhua
ttaatttcaaaatgacaaaacaaaaatgtggctggtggttaaatgacaagtgggctacatrgtgaatgttacctcaagggaaccaagagccctctgctggcgatacaacagacagcaacca

SEQ ID NO: 316 - DNA, 121 bp, Gadus morhua
taccatgattggaaaagcaatgatgattgatgacttttttcttcaattgtctatagtggawtttaaaaaaaaggatgcaccactaaagtaaattatttcatgtttaccataccataagtgt

SEQ ID NO: 317 - DNA, 121 bp, Gadus morhua
cgtatgaggcaggagtccgtttacacaagcagcacggtgttaatgcagcctgtcattctcmggattattggtcacctgggcatatttacccccagatgacctttcccccttgtgtgacaag

SEQ ID NO: 318 - DNA, 121 bp, Gadus morhua
gggtctgatgaagcgctcatacttgggaggctttcgggtgaagccgtcggccacgaagcamactttggtgaccattctcttccacgccttcttctgcctcttgccggtcttgatgactttg

SEQ ID NO: 319 - DNA, 121 bp, Gadus morhua
gctgtgacctcaaccaggatgacattgtccggttattttaaccaactgcttcttttgctcytggtctatccttccgttgccgtccccccaaaaataccacatactctatctttgtattttt

SEQ ID NO: 320 - DNA, 121 bp, Gadus morhua
aattctgttaaggtcagttattacatatttttgcacctgccacttctcattccctcaaccraatcttatacattagcatgtcctgtgggggagcaatctctcctctttgaggtttgatgtc

SEQ ID NO: 321 - DNA, 121 bp, Gadus morhua
cattagcatgtcctgtgggggagcaatctctcctctttgaggtttgatgtcatcgatacartaacaagtaggaaggaacttcaccgtacagaccaagacctccggggcggcctcattatga

SEQ ID NO: 322 - DNA, 121 bp, Gadus morhua
tccggaggacatgtacttgcacagtccggcgtagaagggcatgtccttcaggtccatgtartgcttcttcatgtggtcctcggaaggctgaaggaacttggctgcgaccagtctgaaaccc

SEQ ID NO: 323 - DNA, 121 bp, Gadus morhua
caacagggaacaacccagaaagtgtttctcagcgagtatcgactgcattcctgtgagtcaktccagtcaatttaaggacctgccctgttgaaattgtgatatggcaagtgggagtgttgca

SEQ ID NO: 324 - DNA, 121 bp, Gadus morhua
gcgttgttgcccatcaccacgtggcccaggtttggagtctatcttggcatctagtcgagcrttccggatgaggttgacgatccatctctcgggtttcactctgaggtcatgttgagcttgt

SEQ ID NO: 325 - DNA, 121 bp, Gadus morhua
acatatttattaaagcctattgttacagactttgtacatgtcgaaacttctacctcattcygttgtgtactgaaggcacagtctacatacatgaggtagtagttagtaggtagtacatctt

SEQ ID NO: 326 - DNA, 121 bp, Gadus morhua
agtacacagttaggggacatttgtataacaccattcatcaacagaaagaaacactgaaatkaacactttgagaagtcatttaaaaacagattgataccctagatgcaatttacatcaaacg

SEQ ID NO: 327 - DNA, 121 bp, Gadus morhua
aactggcaaaccacaaaccaaagtaatttatacatggagaaatgctcatgaccaccttagrgaggttggaagataacgatatattagtctgtatcttgaacagttgacgttttggcacatg

SEQ ID NO: 328 - DNA, 121 bp, Gadus morhua
gtgttaatttggtaccaatatgcttacaattaataaaaaacggcaacattacatcgaatgmtaacatgccctttattgaaaaatgtcttcgaaaaaagatcttcaaagcccactggggtat

SEQ ID NO: 329 - DNA, 121 bp, Gadus morhua
ctgttaggcagatagagaatggtaacccatttctccctctaactgctctacagttatagcrccgaggatgggctgacagtcagggttgaacacagaataagcactcagttccccgggttgt

SEQ ID NO: 330 - DNA, 121 bp, Gadus morhua
gaaatgcaatgttctgtgtgtgttaggcaagggcaactttatctagcactatttcatacayaaggggaagactcaaagtacttcacatcatacaacattgtcatacaatgacattacgata

SEQ ID NO: 331 - DNA, 121 bp, Gadus morhua
acaaacaaagattaaaacagatacgagaggctagcagcataaggagaccttcaaacattgragacagacatgacaacataaggactctacgacatgtggttaaacaccagacacaagaaat

SEQ ID NO: 332 - DNA, 121 bp, Gadus morhua
agacaaaaagtaaggtcatttgctttgattcccagattcagtaacataatatccatttccyagtttaaccagtagcgttggaattctattttctgtcccacgagtcactggaaagccagca

SEQ ID NO: 333 - DNA, 121 bp, Gadus morhua
ttaaaactgtacaatgagaagattaaaagtgtgaaccatcttcatggtttatgtgttcacygttaaggtctacagtcggatagaaactagggagaaggatcggcactacagggagtgatgc

SEQ ID NO: 334 - DNA, 121 bp, Gadus morhua
cttgataaagtgcacctgttaggccaagcaatcaagaagcattaaaacgtgatcaagacgrctggactcggccaatcagaggcttgtgttgaccaatcacaagcacaaaccccgtaagagg

SEQ ID NO: 335 - DNA, 121 bp, Gadus morhua
ccggcctgcaggcggcctgcctgtgcactatgtggtcgctgggtctttagagaagagtgckgagtgacatggactcaccgccggtggattcaaagggaatgttgtttttggtgaggagcgc

SEQ ID NO: 336 - DNA, 121 bp, Gadus morhua
tgtagtacagatgatgtaacacacagataatacaaacacagcttaaagcaactttctcaascccacagaaacaggcgttkctcacaccacttaactcacaagataacgtgaactcgaccgt

SEQ ID NO: 337 - DNA, 121 bp, Gadus morhua
actttcaggatggactgactggactttaaaattgattatagatgaaagacttctcattcawttacatacatgtcattcaatatatacaatgttttcagtgtacaaaattacagctccggaa

SEQ ID NO: 338 - DNA, 121 bp, Gadus morhua
ccagcagtccacctcgttcaagtcagctctgaaacacgtcagccaggcaccttctcttgcrggcctgcagcaacccggcagcagaatagaaaaaactcaaccagttgccagtctacacgtt

SEQ ID NO: 339 - DNA, 121 bp, Gadus morhua
tcagggtcacacccaggatgaacaggttaggtcccgtaggttggagaactgaatgattgaygacggttatcagtatcacagggtaaaaaaatatatagaaggattatgaaatgatcataga

SEQ ID NO: 340 - DNA, 121 bp, Gadus morhua
ttttggagtagcataatactaatgagggcatacctcaactaacagcattgctgtaaatacwtttatcaaagtaaagttgaccaaattgtcaatgcagttaccaacatacatggcatccaaa

SEQ ID NO: 341 - DNA, 121 bp, Gadus morhua
gaccaaattgtcaatgcagttaccaacatacatggcatccaaagaggcctcaaaaaggtgratattaaaactggtgctaaatgttcaaggattatcaccataactctgaactcctcagggt

SEQ ID NO: 342 - DNA, 121 bp, Gadus morhua
caggtcctcaggctccatgtcgggctcccacagagactcgcacatgccgtacatctgctcrgagcaggtgccactcacgacgaagtcctcggtgaccatggggcagccgatgaggtccagc

SEQ ID NO: 343 - DNA, 121 bp, Gadus morhua
tacgtaaacaatcatatttagtcaaaacataattataatcatttattatttgatacagaaygtttgggctgctcaagtgggatttctctaaaacccgtttcgtttgtaaaactgggctctg

SEQ ID NO: 344 - DNA, 121 bp, Gadus morhua
ataatgaggcacttttttctctcttctaaaatcgaaacaaaaacagaaccaatagatattyttttgttagagttcagtgctgatgccaggagaagttgacgctctcgtttttcccagtcac

SEQ ID NO: 345 - DNA, 121 bp, Gadus morhua
tttggcagctttagttcagcatttagttcaacgtcatttttcagtagtttgttaaaaagtrtattttcttccatcataataaggttttagtttgcttgtccacgttycttcgcaactctcg

SEQ ID NO: 346 - DNA, 121 bp, Gadus morhua
caagaatcgtcagaagataagttgctgtgaaataatgaaagataacaataaacagagatgytttagttgctttggtgagcggagtccatccttctgatgatgttgaccgtcaagctatatt

SEQ ID NO: 347 - DNA, 121 bp, Gadus morhua
tcataaaaggactgttcccattcttctgcaggatattacacaaatcacatcatgggtgttmcactctgaacattacccaaatcattgtatagcatgtcttcaccgctttgtattcatatgt

SEQ ID NO: 348 - DNA, 121 bp, Gadus morhua
cacggctckgagactccgtcgtaggtgtacyccccggtgatttctgtcatgttgaggcacrcggcctgctgtctggtactcagaggaacctccttcagagcctccaggtcctggtgctccc

SEQ ID NO: 349 - DNA, 121 bp, Gadus morhua
gcaacgttcccacccaccgtcggaatctacgcctcctcaggtgccacgggctctcttcagrtcccggatctgcttgaccaggtagttcttctcgtcgcagaactgctcgtcctcggatcga

SEQ ID NO: 350 - DNA, 121 bp, Gadus morhua
tgtgggttattgcctcgccggtatgtgaaacatcaacgctgtaacgatgtgcaggtacagmagacaatttcagaggggaaacgattaactttgcattcttgctgaaggacagcaacctgcc

SEQ ID NO: 351 - DNA, 121 bp, Gadus morhua
tattttcgtacaaaagccatatggctatgaaacaaaccatcacactaataatgacccatgwtaatcatgggttcaaaaacaaacgagggggggggggaaaagaaaagttattgtaaaaaga

SEQ ID NO: 352 - DNA, 121 bp, Gadus morhua
tttcaatgttttggtcaagaatggtatattacgactgaagtggtccatgttcattatcgtkactgtgttctcgtcacagctcgctgcaatggtttctgtctgcacatttttaaggcatggt

SEQ ID NO: 353 - DNA, 121 bp, Gadus morhua
agctatgagagtgatagcagagcagccattcagaaagaaaagaaggcgagtcagaacggartaaggagggggaacccttacagcgggatccatatctgtggacgacgagtgggcgtggcgg

SEQ ID NO: 354 - DNA, 121 bp, Gadus morhua
gtaccgtagtaactcgtgtactactataactactagttaccgcggtaactagttccaggtstagctgagctaccctgacagcgaaggggtgggatctaagagctacaccaatcagcaggga

SEQ ID NO: 355 - DNA, 121 bp, Gadus morhua
ttttccttttcagaaacttcttctttggactccttcctgatggccctgctccggtgaaggycctgggggggtggattttgaggctctctctgctgtcagttctgtgctttagcttcgcctg

SEQ ID NO: 356 - DNA, 121 bp, Gadus morhua
taaaaacactgacaaagaagtgtaatctatttttcttcaggtaaggacctcgtattatcckggagacattttgaagaaacactaaacaaaatcacccccattcatcatcaccagtccatat

SEQ ID NO: 357 - DNA, 121 bp, Gadus morhua
aacggaccatcccacacttgaaaaatatcactttttaacttctcaaactatgaaagccaarccagtgttatatgctttcaggtataaaacaggtgaagccctttttttgggaagaacattc

SEQ ID NO: 358 - DNA, 121 bp, Gadus morhua
aatgtcacagtccaagggcttcttagcttgagccatgatgaggacattatgggcttcctcrtactcatgcttgtccatgtaagcctggccactgcggaacagggcttcggtgttgtgggga

SEQ ID NO: 359 - DNA, 121 bp, Gadus morhua
tcttggtttcgtttttttagtttcacaaaaacccttctccctcctcttccacatggtggaytgaggacctaggcggttctatactttattgcttaaaaaccagcaacctgttcccgagaat

SEQ ID NO: 360 - DNA, 121 bp, Gadus morhua
tgccactgcataccttaaggaccttaaagtcggggagtggctttgtggtctttatttaatratataatatatgtgcataatcactattctgctaaattaaatataaacaaagcatttgagg

SEQ ID NO: 361 - DNA, 121 bp, Gadus morhua
taaaacaataactcaactgcctacattcacaacaaaacattcgtaggttcagaaggcggcygtgtcatttaccagacgtcacatatattttacacaagcagagactccagtacctagttac

SEQ ID NO: 362 - DNA, 121 bp, Gadus morhua
gtgtaatactaatggttttctagagctccctttttacagggtatttttttttttttatctrtttgccttatacaatagtcctgaaactatctggatggatagttaccaattacaaaggttc

SEQ ID NO: 363 - DNA, 121 bp, Gadus morhua
acagtaatcattctaaagcaggtccaaaatcattacaaatcttaatagtatgacaatatgwggctgaatcaagaacttatagcacacgttgttcaaagtttacaaaatattcctgtataca

SEQ ID NO: 364 - DNA, 121 bp, Gadus morhua
aactcttcttctataatactgccaatgttttcattgagaggcaactgagcgggttccactkttgttcaagccggccaattccacggcccctcgcccaagcccccactcccacatcccttta

SEQ ID NO: 365 - DNA, 121 bp, Gadus morhua
atggaggggagcatggagtttgggacgccggggttccacgttttttcagagtcttccaatrcgttctggcacagccttcccaaattttatgtgaacatcttgtgaacgcgtgggtttggac

SEQ ID NO: 366 - DNA, 121 bp, Gadus morhua
tccttcgactctgagccgcactrtagggcagtaaaaagaggataaaactagtgaaacattrgcaacacatataaggacatgagatgaactctgtagcaaggaacaggtgttttctaatcaa

SEQ ID NO: 367 - DNA, 121 bp, Gadus morhua
cctaacagctcttaacaatcagggtcacacatccgtttatgagatgattcctgaagaggargggcttctgaagatttctttaagacacaaggagcagttctgaggactgcatggagctagg

SEQ ID NO: 368 - DNA, 121 bp, Gadus morhua
cattctttagaacgaccaacacaacattggaagcagtcaacataaaatctgctctttcctytaggccaggccgrtgtgttgagattaatttatattataaacttctttatttaaccattga

SEQ ID NO: 369 - DNA, 121 bp, Gadus morhua
ttctttttagcagacccagactaggaaacctttggaggttcttgcgctcttcaaaacagtrgcatgtctcaggcgaatacttaatcacccccaagagccacataagtgtgttcaattagac

SEQ ID NO: 370 - DNA, 121 bp, Gadus morhua
gcacatggtaaccaaggcccagactctcttccccacagtgagccccgctgtggcgacagamaagcatacggctgaaataaaagtgattctgatctgatggtgacgagggaacccagggggt

SEQ ID NO: 371 - DNA, 121 bp, Gadus morhua
attaacaatcgtacatttagtttttctgaacacactgttccctctgtcacggcatgaatgrtacacactgcaggctaacaacaccacattataattcattaattacacatttaccgaagtg

SEQ ID NO: 372 - DNA, 121 bp, Gadus morhua
ggaatcgcattcaagaataagagactaatgaggagctgatgtgttaatggttgttaattcrgatacacagtattaacatgagtgaacaacttttcaccacgatgacttgccgaatttgaca

SEQ ID NO: 373 - DNA, 121 bp, Gadus morhua
aatttgacaaccaacgtttggaaactaaacacatatgcaggagatcccaaaccatcttgcktgtaactcaagtgcttcaatgacttgatagctacgcagtcaaacagtagaaacaaacata

SEQ ID NO: 374 - DNA, 121 bp, Gadus morhua
gaacctcttggtaacagtcactacgttaccaagtaatcctgagaatccattcaattccgcmatcacaaaatcgggtcaactttccacgacgacagcaccacgtgcatgtcgttgagggacg

SEQ ID NO: 375 - DNA, 121 bp, Gadus morhua
gtaggctatttgccattctgctgtgccacagctccgaaagccgactatattccccgctacmttacaacaccacagcaaatgaccttctgaaaacgataagtgaagccattcgtttcgttag

SEQ ID NO: 376 - DNA, 121 bp, Gadus morhua
aaattgatggaaactctactcgccccttatggccgctaagatgtattttagtgggcagaasgacatgaaagtaaatcactggccttaataacaagtatggcacaaatgtgttataatttga

SEQ ID NO: 377 - DNA, 121 bp, Gadus morhua
gctaaaatagcaaccaaaaatggccaattttgaagatgggtattagatcgttaacaagcamagaacatagaggaaaaaggaagaaccagttaaaaaagaaaacaaacagccatattgaggc

SEQ ID NO: 378 - DNA, 121 bp, Gadus morhua
aacgagtgatcccttatcacttggtgcgagggcaagatgaagtgaaagtgcaccaatgatrtatacaaactgctacccagattggcaaaataataacaaagtgcacagcaggaagacatct

SEQ ID NO: 379 - DNA, 121 bp, Gadus morhua
gaagacatctatgaaggcagaggaaacagttcattaaaaaggcatctcatgaggtacacaragactgaagctaagcttgcaggcacacacatttaacattcaaagttgatttaacattcaa

SEQ ID NO: 380 - DNA, 121 bp, Gadus morhua
tagatctatgtaataaacatatttaataaaataaagacttttgtaatattcttgtctaaarcatttgatgataatatgtttgggtctgaaactaccgtatgttccttttactttatagtaa

SEQ ID NO: 381 - DNA, 121 bp, Gadus morhua
tgttgcatttacaaaaccacaattaaatcttaagtaggacaaaaaatatcatgtaatgacmaaaaaaaggtttaaaggctgtggccaaaaggaaccaaattgttccaagctgaggaataca

SEQ ID NO: 382 - DNA, 121 bp, Gadus morhua
ttaaataaaacattaggtgttttaaaggctataccagcaacagctgccaggtcatacaacrtcaaatctaccgataacacccaatatcgtataccaatcatatgaccctgaccatctagca

SEQ ID NO: 383 - DNA, 121 bp, Gadus morhua
ggttttcactgaccgtctgccccttcttatctggggtctggtacaagcccctgcgctccargaaacagtggcgacagcgcacctcttcgagggagaagcggaacagcttggacttcaccat

SEQ ID NO: 384 - DNA, 121 bp, Gadus morhua
actatgacattaatgcgattaatcacgattaaatattttaatcgcttgacagctctagtawtaatccctccagaaactttgtacattaaaaaaaagaagaggggataagtggrcatagttg

SEQ ID NO: 385 - DNA, 121 bp, Gadus morhua
ttgtgtgaaacatacaatataaaatgctggagatcttaaaaaaaaaaaactgcacattgtsaaaaatgtgactcaagggataccagtgctaaatgccatctcaccaaaatacaacatctgt

SEQ ID NO: 386 - DNA, 121 bp, Gadus morhua
agtttgtaacgttaatccatacatggaaacttgaaatgtcaaatgaagttaaactaaatgrtgcactacgttacttgcattaatccatacatgtacccagtatagcatatgttataccagt

SEQ ID NO: 387 - DNA, 121 bp, Gadus morhua
acgttttccttatcttgggatatgtgctattcactggaatgaattcttcatagcaatgtcwtcactatcatatttgcatccccgttttcattactatgagataaaacgtacagttggaata

SEQ ID NO: 388 - DNA, 121 bp, Gadus morhua
agataattttgttcccaaagataaaacttgcctgacggcgaatgacatgatatcagccagyctccctgagagcgcactctgtatttttagactgaaacgttgaagcgtctcatgtggggaa

SEQ ID NO: 389 - DNA, 121 bp, Gadus morhua
ctttctgtaagagagattcacatgactggtaagtccccacactgagaagcctgtatctttyattgtgggatcataggtcgataccccttggtactgatacaaaaatattgtccaaacaaga

SEQ ID NO: 390 - DNA, 121 bp, Gadus morhua
attggggcgatcatcgatcaaggcacattagaatcatcaaagcagttttcttcgaataccrccatttttactagtgtacactttgggcttaacccatttaccaaatcactgtcaaaaccat

SEQ ID NO: 391 - DNA, 121 bp, Gadus morhua
tagggaaaaccaaaggaaactaactttattaaggagatatggaggtaaacaacccaaccgrtgtgggccgaatcctcactccgccaaagttttcctttgtaaacactggagagagaatgcc

SEQ ID NO: 392 - DNA, 121 bp, Gadus morhua
aaataatgctgacaatgcttctcgtaaaccaaactactcctgtttccctatgagaaacggraatctactttatttgactttcatttcctcctagcgaatccgcctggaggacgcaaacata

SEQ ID NO: 393 - DNA, 121 bp, Gadus morhua
gacaaacctctgtttctaagatggatactgttagcttttggtttgggtaccgtcattttgratgcagtgaatgaaagccattgagaacagaaaaggyttgatttcattttgggacaggaac

SEQ ID NO: 394 - DNA, 121 bp, Gadus morhua
tgttgccgggggtgttccatggcgttcagtgacctgaacccatgtgactcgcatttcagasaaacattgaaaaagaacaaaaaccatgaaaccagcttgcaaacctgtaatcaaactcatg

SEQ ID NO: 395 - DNA, 121 bp, Gadus morhua
tawttgatctttgattaaaawagacgtacaccctgaaataaaccaaaagcacagtgtgttyacatgaacattcaaattcagaatttctttgtcttaagtacttccctcggcaacgttgtag

SEQ ID NO: 396 - DNA, 121 bp, Gadus morhua
attcgatctcttacttatgaaactgacattggtatcaatattcgttagtaaggacgtcatrgtaaacgtaggccagtgaacgcaacaatatcttacattatcgtcgcttggattgagcttc

SEQ ID NO: 397 - DNA, 121 bp, Gadus morhua
tgtttttaatcagttcactggattaatgaattattgtgaatccaaccctctaaccacttcmaggaccaagcacagggtagacaagacaatcagatccagcttgttattcttcaaccgatga

SEQ ID NO: 398 - DNA, 121 bp, Gadus morhua
tgttatggatttattgtacaaattccctggaaaagatgcacgttccaggatgaattgagawgctcccgtaagggctgagatggcagaggacagctgatttggaacggaacaacagctgttc

SEQ ID NO: 399 - DNA, 121 bp, Gadus morhua
cctacttaggcctactaattaacgttcaaaagctattacatattcaacaaaatatgcagawactgtcaaaatcgggtccagggaagtatataaggattattaatgttgtttttgatggtgt

SEQ ID NO: 400 - DNA, 121 bp, Gadus morhua
ttatttgtcctgacaattactacaagagaaaatgctgttctggtgaagagaaacaagagcracaaaaaactaatatcttacagggtcatgacaactcaagtaatacagaaaaaagtatatc

SEQ ID NO: 401 - DNA, 121 bp, Gadus morhua
ccaaatttttaatgaaacaacccttccttttataaacctttggctttccttttgaacgtgygtctgcgttagagcaaagccttaagtaaagctcagtgaactttgggctgggcagtggatc

SEQ ID NO: 402 - DNA, 121 bp, Gadus morhua
tttggcatgggcattaccatgacttacagtaaatttgtgtccatagataaatcttcaagaytttgtcatggtcaaaccaaacaagaataacaattttcaatgaaaactgaaagtagtccat

SEQ ID NO: 403 - DNA, 121 bp, Gadus morhua
ctgtttctgtttctggcatataagcggtatcctcggcaatacacacaggtaaccaccataraccgtcagcagcatcattgatccagaaaagtgcccgatatccataatcagccactcgctt

SEQ ID NO: 404 - DNA, 121 bp, Gadus morhua
attgaggcaatatgaccaactataaataaatcaggctggccttataggcaaatataatctkaagcctacatattattcaatacataatatgtatgaaacttaatacagctctcataaaggg

SEQ ID NO: 405 - DNA, 121 bp, Gadus morhua
tttttacctgatgttcagtttcacaattagtatagatattgtgataagatggagtgtacawtattttttgatatgttcattattcattaatccgtattttgcagagtagatgcttgagatg

SEQ ID NO: 406 - DNA, 121 bp, Gadus morhua
ggttatgaaatacactgatttacccctagttacatggggggctttcttactcatcacaatratcagtttgctgtaaaacatttaacgaatgaaccccatggcattacagaggatcggatat

SEQ ID NO: 407 - DNA, 121 bp, Gadus morhua
tgggctgtgacgggtcacagggttaactaaactgacccggttggattctctctgaatcttygaggaaaaccacaatacatcactcagttaactataatttatggggtggaaacacggttca

SEQ ID NO: 408 - DNA, 121 bp, Gadus morhua
tcgttaaaatataccagatgggagtgacccgttagcattaggaaataacgagaacacactwagattaacaaaaataaaaggactttacascagtttaaatgggtatataaaaggagttagt

SEQ ID NO: 409 - DNA, 121 bp, Gadus morhua
tttctgtattttttaggtcaccatgaacggacactaagacaatgtgatcgttatttaaatkatattgaatgttgacagctcggagtgatcaagggaaacgatacaaatctgctcccactgg

SEQ ID NO: 410 - DNA, 121 bp, Gadus morhua
atcgttttaccaccgctttggaaatctaaaagtaccagaaaaaatgctgaagaggagatgmgatctgaccagtggacagtgtccctgctctggggtacacctctctctaaaacaccaggct

SEQ ID NO: 411 - DNA, 121 bp, Gadus morhua
gtagctaaggtgtgatgggtaggtagttaggtaggattttggaggtaggtagttagctagratgtgtgtggttcctaggaagcaaacataaagtacaacaatgagctccaaaattcatggc

SEQ ID NO: 412 - DNA, 121 bp, Gadus morhua
aaaatgtttatttatccaccagataacccaacataagccaaactttcacagagggctgaartacaaagtttctatcgtatcaagtcacaaataccctcacactctgactcaaatcgcaatg

SEQ ID NO: 413 - DNA, 121 bp, Gadus morhua
tcgtatcaagtcacaaataccctcacactctgactcaaatcgcaatgagacatttttttcsacgtccttaatcagatttctccttttctttcatgtgcaaaaagacgatgctgaagacgaa

SEQ ID NO: 414 - DNA, 121 bp, Gadus morhua
ctatatacattatccataaccactttttcttactttacaccaatggtaccaaaatatggtwaaaaaaaaaaaaaaaaacatgacttcaatggtcgtcttacactgttggtgtggtgtgcct

SEQ ID NO: 415 - DNA, 121 bp, Gadus morhua
aataactgttggtcattttctctgtgatgggggggatgcaacaaaagggagaaggccagcmtctccttcacgtagcatcagtgttagcttttggcagattaacagcttgttttactaggtc

SEQ ID NO: 416 - DNA, 121 bp, Gadus morhua
gaggagcaagtccacatttgccaggagtgttccggaccagggcgkctgacggcggcaggtygggccgtatgcatgtaacaggcctctgcttttgactcttgcatgttggagcttcaaggtc

SEQ ID NO: 417 - DNA, 121 bp, Gadus morhua
agacctgaagctggttacagctaacgacggccaattaacacaaaaaataagttttatttarcagccaagggtggtcaagattaggtttttgttcggaaaatcggtaagtcataaaccagac

SEQ ID NO: 418 - DNA, 121 bp, Gadus morhua
gtagttttctgatccactcggtatttaatgaagtgatccagtatgagaagccttcatagcrctctacaataatgatttgttaggctatagtcttggtttaatctaaatatacagcaaatga

SEQ ID NO: 419 - DNA, 121 bp, Gadus morhua
ttcgacctgatcctgcatccgcttggattcataccacaaatcgacaacaatgaacgccgcwgggaatggaccgtgctggtgatttccacgtgctggccgttgacccggtacacaacaacgc

SEQ ID NO: 420 - DNA, 121 bp, Gadus morhua
acccctccacacatcaacaaggcagggcagcgagccctgcctggtacgagaactcttttgraattcagtctctgacggagagttgcagtgcacttactctgttatgaacactgaactgata

SEQ ID NO: 421 - DNA, 121 bp, Gadus morhua
gttttgtccctgttgtggttctttcyctcagtgaatacatcccagctaccgcacacaaccrttacactctctacgatcaaaataacatcctcatacactaagcatatggaagagaacaaaa

SEQ ID NO: 422 - DNA, 121 bp, Gadus morhua
atactcaacatgaaatggttatcaatatgttttcgtaatgctcagctagttctcactgaasgaaaaccaattcactcgtgcatacatctgccgcaacctaaaaataatcgcattgcataca

SEQ ID NO: 423 - DNA, 121 bp, Gadus morhua
ctgcctttgtgaatgtcggcgaatatataatcgactattcgttcataaccacccactgatyattcgaccatgtgagctattcacatccctacttataatatactttctggcttgaaaacca

SEQ ID NO: 424 - DNA, 121 bp, Gadus morhua
cttattttactttgttatttaacattgtattacaataccttgccctatattctccatctgyatccaaacaaaggacaacaaaatatgtgcgyaagaaaccaaacttccatagccaagttaa

SEQ ID NO: 425 - DNA, 121 bp, Gadus morhua
aatatatactaaagatatgtaatgcatcaatrcaacaatctgtatacaacaaaacagaatwaaagccaaacaaaagcactgttaggtaaagcataacaagcacatggaaacatcctttctg

SEQ ID NO: 426 - DNA, 121 bp, Gadus morhua
cggagaaaaacaaacaaataaatacaatcttgaaaatatgacattacatcatacagtattmatcttggaagtgcaaagataaagagtcgtttcagagcaggacaaacaaacaaaggtaact

SEQ ID NO: 427 - DNA, 121 bp, Gadus morhua
cgtcggaaagtaagaattagtaagaatatgtattgcgttgatactggtggtattcagaaaytggaagagaaaaacaattcgttccaatagattccgcttcatattttccttttccggtcga

SEQ ID NO: 428 - DNA, 121 bp, Gadus morhua
catggcagataagataggtgtgacctttgacctgtatacgcttacaaagtatatataaaarcaatgtttgagaaaatgtagccattattcccccccaccaaaaaaaaagagtcatttacaa

SEQ ID NO: 429 - DNA, 121 bp, Gadus morhua
gcgttaccttacaagtacaggggcctgggtggccggttggcgccggaagctgggagcacaycgtacagtacggtctctaaagtcatcaccaccaaacaaagggcgcactcatacaaaagaa

SEQ ID NO: 430 - DNA, 121 bp, Gadus morhua
gagcaaatctcctgaatcacagtgtcattttaagagttacacttcgttcactgcttttatyggggtcgtgttgagtaggagcgaagaaggctttttagtcaacaagtgaagcaatgaaggg

SEQ ID NO: 431 - DNA, 121 bp, Gadus morhua
tcaacgacaatgcctgagagcggtcatcgtaggtcacacacaggtgtcgctcgtaaacacyaattaggtgggctgcttcctttatgtaccagggcacgggtggagacccccactagggaag

SEQ ID NO: 432 - DNA, 121 bp, Gadus morhua
cagcagtatcaatttgatcattgaaaccagcaactatatttggaacatattctagacatamagaactgacccaatagcaaaacagccttgcacatagcaacatttgtgcactaggctaaag

SEQ ID NO: 433 - DNA, 121 bp, Gadus morhua
acccttcagtgaccaatcaagacaggtttgcatgtgttgatgcttttgaatgcaatggaaraaatacattggttcaagtacatcaattgaaaaactttgcccatcaatcagccataacccc

SEQ ID NO: 434 - DNA, 121 bp, Gadus morhua
ttggctcttgaagcaccatgaaggggcgctcacaggcctaaagaggaggtgtggccagackcctggtcctagactaaacccccacggacctgctagcctaggaactacagccgactgtcta

SEQ ID NO: 435 - DNA, 121 bp, Gadus morhua
ctctctagaaatgtcccttctagttagtacccaaagccaacatgtctgtatgaaacagtamgacatggaaagccttcaactttcttatttccrcctcagttcatctagtcttcaggtgttt

SEQ ID NO: 436 - DNA, 121 bp, Gadus morhua
agtgactagcaccctcttgggtgatgcatgagagccaatctgcgccaggaacgctcaccamacaccagcttgaggtggagagtgaggggattaatgagtcagccagttggacaggagcaca

SEQ ID NO: 437 - DNA, 121 bp, Gadus morhua
cgtaaagtaggggttcggcctcgttcggaaatggatacagatgtggagggcgacggtgggygtgtccatgtgaaatagtaatacaaaataaaaatatagagtctgtcatagggaccctata

SEQ ID NO: 438 - DNA, 121 bp, Gadus morhua
gctacaagttcaaaataacattcagatgtattctttaacgccatcgattatattaacctcmgaagaagttacattttaaaggtatggctgcacaatatcaactataaattttgccttaaca

SEQ ID NO: 439 - DNA, 121 bp, Gadus morhua
ccaatccaatgcaagtcatcgaagacaccgttacatacgagggacaacagcataagcagcrgaacaaaaatgtaataagcacatacatcacctcgtttcaacatgtgtgtgtacagggcag

SEQ ID NO: 440 - DNA, 121 bp, Gadus morhua
aggctttaatctagatgcattgtaatccaaaattggagctgataagatatgtaaaacaagyactactgccaaatgcgggggaaattgtattacgacaaaagtgtgataarctggtccaaaa

SEQ ID NO: 441 - DNA, 121 bp, Gadus morhua
cgctcttctaacaatcggaagaggttacagaatggaagaaaaaaaaaaaaataacatcctraacactgcctccatcttttatccttacattttacaatgacagcattggcccatctcgtaa

SEQ ID NO: 442 - DNA, 121 bp, Gadus morhua
ttatccttacattttacaatgacagcattggcccatctcgtaatgtttgctgcttcatttkgatgcgagcattattttttccttgatttatattccacttaaacgatgtgtttgtatgcgt

SEQ ID NO: 443 - DNA, 121 bp, Gadus morhua
atattccacttaaacgatgtgtttgtatgcgtctatgtgtgtgatactgtgtgtagcagcmttatgatttatagagatgccatttaattaggtatatacaggtacctaatgaaccgccaag

SEQ ID NO: 444 - DNA, 121 bp, Gadus morhua
tacagctaatagctccagcgcctcctgttggttcacaccggggataaccatcctcatcttyctttagttatttatccatcacttttatcctttccaagttcaccactgaaatttaataaaa

SEQ ID NO: 445 - DNA, 121 bp, Gadus morhua
ttgtaacatagttaaattattaacattgaatatacctcttgttaatccaaccaagagtttmctgctgatctgcacagcagaggttcaacaagggttggactccagccatattctgattcgt

SEQ ID NO: 446 - DNA, 121 bp, Gadus morhua
attccagacaaggccttctggaacgactccccccttcatatacacaaggctgaggatcacraagagcaaacccgtcttgggatatgccgcttatcatctcgctcccctccactggctccag

SEQ ID NO: 447 - DNA, 121 bp, Gadus morhua
cataaacacggtaatgaaactaaacagatatgaatcattacatttgtcttatacgtcgtcmcattacaaactaaatataaaactcgtcaactggtcggttacacattttgaattaaatgct

SEQ ID NO: 448 - DNA, 121 bp, Gadus morhua
aagtggaaaataaatatgaaacatatctttgaatgcaatcagcgacattgactatacaatrataaaagtaatagaagggcaaatctaaagaattcgagaactcccaggacattccagatgc

SEQ ID NO: 449 - DNA, 121 bp, Gadus morhua
atgcataatatgacattgctatttttgctaaataatcagttgttcctcacttaagtttgcrtgacacggaacaagagaattgtttttttcaactgttcccaattgtcttagcagcaccgct

SEQ ID NO: 450 - DNA, 121 bp, Gadus morhua
gttcccgttcccttaactcaatactactgtctgccggcagcagtttcagtttttactttartaactttgaccagctggtgttcaaccttactgaaccgattgcatttacaaacagggatga

SEQ ID NO: 451 - DNA, 121 bp, Gadus morhua
ggggtccagcaccagtcttgttactcggaccttggccgtcttcagcatcttggtcccgatyactctgccgatgatccacttggcatggactgatgcctgcttggccgacattgtggatata

SEQ ID NO: 452 - DNA, 121 bp, Gadus morhua
gtttgtaataatttattactttcgccatttacacataatttttccttgtccaatttacacmcgagttcaataatgttgacttattggggaacttcaacatgtattgttagatctataattc

SEQ ID NO: 453 - DNA, 121 bp, Gadus morhua
gtggacycckgcgcgcagcccggtgcccaggttggaggggcaggtgagcacgtagcccagrtgctcgttccagatgaactcgtgtttcctctccttgaacagtttctcgatcttggtgagg

SEQ ID NO: 454 - DNA, 121 bp, Gadus morhua
gggggcttcagtgacgggtcgtggtggctttctttttttcaaaggccgaagagagtttgaraccagcattgtgtccgggtgcttcttgtcctctcctcctcctgtaacagttagcggggcg

SEQ ID NO: 455 - DNA, 121 bp, Gadus morhua
gatgtgtctaaagtgcacctgcattcaaacattctttgatagcagggttttgacacctacyacatttctaaattgccccataagcaactggctaaaaaaatttaaatgaacaaaaatatat

SEQ ID NO: 456 - DNA, 121 bp, Gadus morhua
tgccatttcaccagttccatcaataatgctccagatgttcccgcctccgtcggctccctawctcagagaacctccagtgggtggtgttccaggatgtcatctccacaggccctgagtgtgc

SEQ ID NO: 457 - DNA, 121 bp, Gadus morhua
tgaaacatagcctattgtatttacagaatattgtgttgttcacggtaaggttaacagtgtrgaaacatatccttttaccatataggctatacattcattcagaaagacaatataaataaaa

SEQ ID NO: 458 - DNA, 121 bp, Gadus morhua
acatcattgtacgctcaaagccataaaaaagatttagggtaatggttacatagctagtaawtaacgacggtttggtctgcggtaagagcttttcttgtttctctacagctgttctgtagca

SEQ ID NO: 459 - DNA, 121 bp, Gadus morhua
gaagcataatcaagtagaacaccaatcacctattagcagcaagagttacatcattacagcrgctgccaatcaggtgccccgttccgagcaggtgatcaaatcaatacattcccattggttg

SEQ ID NO: 460 - DNA, 121 bp, Gadus morhua
acaaatggttcaattctaattatgaggcccaaatagtttctgtttacaacaacctttaatwattggggtacgagcaataaaaaatacctgaatactgaaaaccctgtcaaccaacccagtt

SEQ ID NO: 461 - DNA, 121 bp, Gadus morhua
gaaaatacattttgacttttctaaagaacagacattgatttcatttgtataactcaatggsattagtaaccagaagccagagtccgctgttgagttagaaaacaaaccaaacgcaccattt

SEQ ID NO: 462 - DNA, 121 bp, Gadus morhua
cagaagccagagtccgctgttgagttagaaaacaaaccaaacgcaccatttatgtgttatwcttcatgttttactggttgcctgaatcagttcctgttttgacaattagccacccctctcc

SEQ ID NO: 463 - DNA, 121 bp, Gadus morhua
cagacatttttgttcatttgtaaaaaaagataaaatacataactacattcagccctatttwaccattcagcttaatatatgaatttgaatgaataaagtatgatgcgactaaacaaacata

SEQ ID NO: 464 - DNA, 121 bp, Gadus morhua
tccttcagttgactccatgtaggcctgcagaaactcttttctctgaaaccatctttcctcrtcccctcctcccagctcctcctcttccccttcttcctctcctcttcctctttcttcttcc

SEQ ID NO: 465 - DNA, 121 bp, Gadus morhua
tacatactatacagtattgctgtttcttcaaaaaggcgatagggggcttaaacgttcttckgggtcttgttggacgtcctatacaaacaaactattctgtcatttaggtttgaagacaggc

SEQ ID NO: 466 - DNA, 121 bp, Gadus morhua
agtcaattgattttaagagacaacatttatttatctaacaagatttaaaaaaatccaggtragaagccctgaactttcaatttcacaacctcttctcaaaaccccagacatctcaaaccaa

SEQ ID NO: 467 - DNA, 121 bp, Gadus morhua
ggaatctttatctttgccactcccttcaaagaatatcttcctgtcaagcattatgcttcaygactttgattgagattgacaccaataaaaagcctgcacagaagaccatttagagtccatt

SEQ ID NO: 468 - DNA, 121 bp, Gadus morhua
tacaaaaatcgttcaacagctttataggcaaacaaacttgtcccaatattcactgttttcwaaccaaaaaaacaaactatgattaaattgttagcctaaatttccagtgtctgatgacgtt

SEQ ID NO: 469 - DNA, 121 bp, Gadus morhua
ggttggttatcattcagggtctgtatctgtcctctccctcttagagatgaggcatgatgcmaatggcagcaaaaatgtatctcggcaaatctcaagagtttaaaaacagccaccttaagaa

SEQ ID NO: 470 - DNA, 121 bp, Gadus morhua
tcggaaaatatcatttcggaatggaatgtctgagtttcactttacttttaatgctttttaygataccctaagccattttccatatttctctccttcatgtagagcacagtgataccgggct

SEQ ID NO: 471 - DNA, 121 bp, Gadus morhua
ccaaggcaggtacgaactggtacggtgtttcacagataggcattatgacagatatactgtrtagaaaaacacaagaaaacagatgattggtcacatacaccacttaaaaatgaacaaaata

SEQ ID NO: 472 - DNA, 121 bp, Gadus morhua
ttgctaatccccccgaactaccccatggtgcgagagcagggttagcatcccaaatatcgasggccaacatagattcagtggtcactagtatcccacgtcatatcaaaaatggctgctgtgc

SEQ ID NO: 473 - DNA, 121 bp, Gadus morhua
aactaatagcacatttgggacaaaacttgtaactatgtatatgtatttttcttcccacctrggttatatttatattgaccaacgaaaataatcccaccttaaacactttaaactgacctaa

SEQ ID NO: 474 - DNA, 121 bp, Gadus morhua
tcaaactaattacaaagcatgttctttggcttgactggttacagaaacacgagttcagtcktatggtcgttgagaagcgtatgttttacatccctggacatcgctgaggatgacttcagtc

SEQ ID NO: 475 - DNA, 121 bp, Gadus morhua
agttttcgatgaacacctttatatatacccatgtaggggcaaaaatgttggacccattacrttcttctagccatgaatctgaacttcctgtgtacatcctcgtttccaaattaaaaccaaa

SEQ ID NO: 476 - DNA, 121 bp, Gadus morhua
ctcacatcccactcataagccctccacggttacagcatttgttaagtaagggttggagtargaggaaggcttccagaatgttcagacttgtgaagtagtacgctcattaaaaaggctatgc

SEQ ID NO: 477 - DNA, 121 bp, Gadus morhua
ccagaatgttcagacttgtgaagtagtacgctcattaaaaaggctatgctggctaagccakgatataaaagcgttgatgtagcgatgcaagcttcactagcacttgaatggcacgagatat

SEQ ID NO: 478 - DNA, 121 bp, Gadus morhua
tcgaacactggccaatcacaaatgcaaatagtggggatggatatatatatatattttkgtwtgtttttatctgttaaatacagccatattatttcttgtagaaatgggtttcactgcttct

SEQ ID NO: 479 - DNA, 121 bp, Gadus morhua
acagtgttgtacgagcgaaacagatattcgtattttgtcatttaaagattttattgtggcraaatttaaactctatggtagtgatgaattaatataatatttgttagraasagaataaaat

SEQ ID NO: 480 - DNA, 121 bp, Gadus morhua
cctactaccacgacgtagtatattttaaacgaggaacccagcgaataaaaaacggaatatyggtcgatacttaaaatggccacccaccaccggtagaactagtaacaccccgtgcagtaac

SEQ ID NO: 481 - DNA, 121 bp, Gadus morhua
atcctcacacaccaagtgcataaagaaagagcttctgatgagcagtgtaaaccgtcagccsgccgtttgaacgggagacgccgcgataaaggtcttgagacgaaaggtgaggcgggtcgtt

SEQ ID NO: 482 - DNA, 121 bp, Gadus morhua
gtgttccgcgctcccactacgtgtcaaagccatggctcacattactatacaggttgaataytcaccaggcatccccacacccaccatttcccccacccccaaaaaggcagacgactcttga

SEQ ID NO: 483 - DNA, 121 bp, Gadus morhua
ctggagttacaggaatacattggagtgcccccccccctccccgccccagatgttaattcgscattcttaatccacttcaaaatcgaacctattgtgactgcagacgtgaacaggtccaccc

SEQ ID NO: 484 - DNA, 121 bp, Gadus morhua
gtacagagcagtggactcactgtagatattggtcactcactggggggatgactttgttttwaaatttcttgcaatggcataatcaacattataccaggggccctccttaaacaggtggcaa

SEQ ID NO: 485 - DNA, 121 bp, Gadus morhua
tgaggcatcctaggtataaatgatgttgccttgcccgtcacacacaatctgtgaacactgsacaaaaatatcaaattcctgagcaggacagtcatgacaaccggtcggggataatttatat

SEQ ID NO: 486 - DNA, 121 bp, Gadus morhua
agtcatgacaaccggtcggggataatttatataaatacgtgagagaaaagcttgaaattcmagttaaactacatacataattataaattttagctactagcaaactttacactctataagc

SEQ ID NO: 487 - DNA, 121 bp, Gadus morhua
ggaaattctaggcaaccggttagtgtatagatacaacatcaccaacaataacatcagtctmgagaaacagaggcgaaggtgtagaacaaaaaatatataacccacatacagatttgttctc

SEQ ID NO: 488 - DNA, 121 bp, Gadus morhua
tctcatgtttacagataggaaaggacgcaaaaaaaatcaaatcttaacctgtgtactatamaatgttatcattacatttggatttgggaatggcccatgaacattgataaagccttgcacg

SEQ ID NO: 489 - DNA, 121 bp, Gadus morhua
tatctggatgtaacctgtttcaataaattcagtctacaagtctactcaagtgctctagtcrgtgttgtagtctttataaccaagatttcacacgcacgacaaacgaaaagctaaattagag

SEQ ID NO: 490 - DNA, 121 bp, Gadus morhua
aatgttacatgtttgggatttaaagtgggccacaatgataaaatgtttgaatgtrcaaatmggaggatatgattttctttacatacccaataagtataaagaaacaacggatgaatgaatg

SEQ ID NO: 491 - DNA, 121 bp, Gadus morhua
tgaatgtcactacgttagtaacaataaaatatcgtcatgcatagaaatcactctcaagttygatatccctatdttacatctgaattctatgctatatgttcatcattgtagacctatacat

SEQ ID NO: 492 - DNA, 121 bp, Gadus morhua
ttcgctgttttcatggcagtttggggtagagttggaaatctacaatcgtacctcctgaaaraaatctcctttccagtgcagtccgatgttctctcgttcaagccaacagcgcacaagaagt

SEQ ID NO: 493 - DNA, 121 bp, Gadus morhua
cttcacagttactacagacaccagaaacttcaaaatacatgcaatgttccacagtacatcwgattctctctcttcagttcatatgtacaacagcgtatgtcacgagtataaaatgaaaagc

SEQ ID NO: 494 - DNA, 121 bp, Gadus morhua
ctatggtcacagtgaggcggggggtggaagggtgaccagatcaggtcaagtcctttcgtaraatggaagaggagaccagaacagcccgtttacattacgttctccaattcacacatcctgc

SEQ ID NO: 495 - DNA, 121 bp, Gadus morhua
agtcggtacctttgatttccttatttcttttgattgtttcataacagtttgcttttccttragtggtttccttgtctcaggttctttgaggtgtttctttgcttcttcatcttccttagaa

SEQ ID NO: 496 - DNA, 121 bp, Gadus morhua
ggtgctgaactcaggaccctatgaggtccagaacaaggcaagaagcagaacaaagaggtgygtgtctgattgtgcacgcacgcgcttgtgtgtatgtgcctgtgtgtgtgtttgacacgcg

SEQ ID NO: 497 - DNA, 121 bp, Gadus morhua
gtacaatgaagatygtgataaattctttttaatattgagttaatgacattgcagtcttatygacagcttcaggacctagatttagctttagagggaacacatgaatgtgagccattcagtc

SEQ ID NO: 498 - DNA, 121 bp, Gadus morhua
tttagtcgaggatccaattcagaaaaattggcattaaaaaaaattcggacctcctagaccraaattattgatttaaacaaatttctacaaaggtgggaaagtcctacacccgaggattttc

SEQ ID NO: 499 - DNA, 121 bp, Gadus morhua
tggtacgagaaaaaaagctggctagcaagttgtgacgcagtccctcacaaccccacagcascaccctacccctgtcaagtgtatattgtatatagttctctgcaaacctttggtggcatca

SEQ ID NO: 500 - DNA, 121 bp, Gadus morhua
ccgctaaggatggatactgcagagcacttcctttcacttggcatcacttcaatcaagcatyaagacgtagcctgaaatgacacaatgtacaggatacacgattcattctaagcatgcgatg

SEQ ID NO: 501 - DNA, 121 bp, Gadus morhua
acccatcatttgggcagctcgtctattgttccatctttgtattccactccttcctcacacycgtccctcagtgaccctccccaccccccatagcatttggtgaaaagtccaggatttttag

SEQ ID NO: 502 - DNA, 121 bp, Gadus morhua
gcagatggttgaattgaagcgatttattttctccctcaatcagtgtctgttagcactaccycttcttatattttaactattctctgagcaacagtaaatctaccccccaccaccacgccgt

SEQ ID NO: 503 - DNA, 121 bp, Gadus morhua
aaatgggatgctgggaaaagaacgaaaaataccctttagaagtgtatgaatgggcagcatkatttgaatttgggtttctacataagaccgttagcagattctctcggccatcacagtgcta

SEQ ID NO: 504 - DNA, 121 bp, Gadus morhua
aagtttattatatagtttgataagtaacggttaaaaatagaacgataaaaaagatctttgmattgcacaacattgtacagtaaaaaaaatcccagaaaaaataattaaggtgtttgcatgt

SEQ ID NO: 505 - DNA, 121 bp, Gadus morhua
aaagtgaaggaaattgggattccaagacagggaatccatgtggaaccttcctctgctgccycacacaacataacaagtggtagagaacgcagcattaaaaccacaagcttcttagtaaaat

SEQ ID NO: 506 - DNA, 121 bp, Gadus morhua
aaataggtagtagattaaaacagtttcttgagttacaggaatgaagaaaaagtatgtacaytcaattttgttgtaaagtacaattctgttgaactttgaaagttctcactggctaaaagaa

SEQ ID NO: 507 - DNA, 121 bp, Gadus morhua
acacaaacctcataaaaaatattaagttccacatcaaaatcacctgacaaaaagtctcatyatctgtgcgtactgaactagtgacgacatacagagcggttgtgtgcatatgttagaaaaa

SEQ ID NO: 508 - DNA, 121 bp, Gadus morhua
attcctccaaccgaccgatgcagcctccctctagcttgtagcatgttggacgggtggtctytctggccacagagttcccttggagtcttacagcagctgtccggcaccatcatagcatttg

SEQ ID NO: 509 - DNA, 121 bp, Gadus morhua
cgtgcagttctgagttatgccttatcggatcaggggcaaaacaggacatacgcagtctgcrgggcaggtcacatgcacattttaaatgtaccaatatttcataaaaggtcatttcatgggc

SEQ ID NO: 510 - DNA, 121 bp, Gadus morhua
tagaaacaaatgtacattagaaatataatctacaatagatttattttactgcaaatgttamatgtattttcacgctctgatyatatattgtatgtggtaattgcggaagacatcctgtttt

SEQ ID NO: 511 - DNA, 121 bp, Gadus morhua
ccaccactttccgtttttgtaaataaaaggacaacgtatgaaaggaaacaaaactcccatyatcaaaataaccctttgatctatatggtttgttctttcagaagcagcatattgttgtgcg

SEQ ID NO: 512 - DNA, 121 bp, Gadus morhua
agagaatagaaaaataataacatacatttacatttcttaaacaaaacaaaaaatccaccascacattttccgctgcttacaacagcaggttaaatacttgtcaccatttctttgtgtcata

SEQ ID NO: 513 - DNA, 121 bp, Gadus morhua
gtagcgcagctttgccttctctttcctcttctgctccagcgtcgctgtgatcgcctggtayttccagccgacctcatgggccaagcgcccaagaagagcaaacttgcgagtgggcttcagg

SEQ ID NO: 514 - DNA, 121 bp, Gadus morhua
acaacaaaaaaaattgagaattcttatttttaacatctttttttttgttgttgtttgcttyacatatatattaacacttttctaaagaatcaaaatatttatccacaggtactggaaaaag

SEQ ID NO: 515 - DNA, 121 bp, Gadus morhua
tgagaagaagtgacatctttgccctgcagcaagtacaattaaagcatcgtcaatcaccccrgatgcttttgtcgattagtttggtctgtccagcctccaagtctcttgcctcgactgtctc

SEQ ID NO: 516 - DNA, 121 bp, Gadus morhua
aatgttttcaaaaaggaagtaaccactggcaattattaaggccacaaaacaatgtttcacsctgaactgaaataaagttacatcacacattcaagctgttttcacttcagcgtatccgccc

SEQ ID NO: 517 - DNA, 121 bp, Gadus morhua
ctagacactagcgatctattcttcctgaggaacaattagtaactcatcctttagaaatgasggctggagatgacatcctgttagtaaccaatacttcctgtggatcatgttacagaggtat

SEQ ID NO: 518 - DNA, 121 bp, Gadus morhua
tctggtggtcgctcccaacctgtgattacgttttgttttgcttctttttctctctctgcgwgctgcagaatgccgttcgagcttgttcagataagacatgccaggcagaaggttctagatg

SEQ ID NO: 519 - DNA, 121 bp, Gadus morhua
agcgcaattaaggaaaatgtaaacaagtatgcaatacaactgcacaatgagtcctatacayccatatacaaaactgcccaatgggcgacttcaagtttgtcataaagttgacgtttcataa

SEQ ID NO: 520 - DNA, 121 bp, Gadus morhua
taataaaagccagcctgccctaaaagcccccccttgcttaaagccagcgtgcccttcttgrtcagcagttggctgtccagaaaaggccaaacacatcgacactcattctacacccctagcc

SEQ ID NO: 521 - DNA, 121 bp, Gadus morhua
acagaataaacggcttgcctccgttcccaccctcccgctcatacgttcaacagtggtttaraaattgtgaagaatagattttataaagacttttatagtccaaaaataatataacctattc

SEQ ID NO: 522 - DNA, 121 bp, Gadus morhua
ttattttaacaaaatacttagaataggccttcatttccatccatagaagcgcttcaaatamccgcacccatacacgagttgtagggttaaccctaaccccaactcttaaactaatcgtcac

SEQ ID NO: 523 - DNA, 121 bp, Gadus morhua
gtgcctcagggtaattgttgtttacctgagggggaaactcattcttacattcctaaatggkaccgaccctcattatgggggctttaagctgccttagtattacgggaggtccatcagatgt

SEQ ID NO: 524 - DNA, 121 bp, Gadus morhua
aagtagrgcgagggttcccaggggagaaaaccacggccatgttagatgttgtacgccatgyccacatactgcatgcatgatggggaaacaggtcgccctgtaaaattgtctyctgatgatt

SEQ ID NO: 525 - DNA, 121 bp, Gadus morhua
tttcttccatctgtacaattacccagtttattttgtttcctccatgccagagttcgggggrgggggggagatgcgtgttcagacttcacaatcaccaccgccttccatggcgggaagaacc

SEQ ID NO: 526 - DNA, 121 bp, Gadus morhua
cttgaaactcacactaatgccatgccctcagatccacagcaagttgcgggtctaccaacaratgtgtagaaaaagaaacaataaatgtggggctgtgatacaatgtcaaacacttactggg

SEQ ID NO: 527 - DNA, 121 bp, Gadus morhua
gaaatggctttatgtacatgtagcgtaagaaaacaaatggttttcatatacatgtagcgawttgcatgaaaacttaaccaagtttatcatctctgtcaaatggtggcaaaggaagtacaga

SEQ ID NO: 528 - DNA, 121 bp, Gadus morhua
gaatatgcttcaaggaaggggtcagagatgaacagacatcccagggccctgttcccttacygccagctgcagagtggtacacatccctgggtattgcagggctctttcctccctcgtatct

SEQ ID NO: 529 - DNA, 121 bp, Gadus morhua
gattggatggaatgttatggctgagaacagctgtgttaaataaagaccgtaaaaaccaatscaataaggataaatatccagtgtttcagaaagtatttatcaatgcttctgaaaggggtta

SEQ ID NO: 530 - DNA, 121 bp, Gadus morhua
aacatacaaaagaggcggggtcagttgggctggaacaggttacatgttgtcttcatcagartcatcctcttcctccagagaatccttggcgtatttctactgcttcctcccgtacgtcctt

SEQ ID NO: 531 - DNA, 121 bp, Gadus morhua
taaagaatgtacagatatattactcttttaattggcattctgagcaaaagcgacaacagayattaaattttcttaacagctggccagttatagactagcttggaaaagcagccacctattg

SEQ ID NO: 532 - DNA, 121 bp, Gadus morhua
agcaacaaacattaaagagtaactactcattaggtacacttatcggagttaacagtcatawcagggctaatgctacatgctaagaacatgctaggccaattgtgatgtgaaaacaaagctt

SEQ ID NO: 533 - DNA, 121 bp, Gadus morhua
catcatacatcagttataattcattgctctaatggaaatagttgcttcctttgcatcctcwgcttcacattacaggatccactagatgtttcttgaggtccttctcactttgtctttataa

SEQ ID NO: 534 - DNA, 121 bp, Gadus morhua
tacagaacttccaaataatacctttttgaagttcacccacaccatgttgtttttcattcamcgcttgagcaagggttcatccatcatttgcctcccgtttgtattcatttacttagaaaga

SEQ ID NO: 535 - DNA, 121 bp, Gadus morhua
ctaagaattattctgttgcttttatttggcagattggcaagagaggaccgggtcagacggrccccactatacactacggctagaaaaatgaacttacacgacatgaactgtacaattgtat

SEQ ID NO: 536 - DNA, 121 bp, Gadus morhua
caaaaacagaggagacacagccaacagggctctcattagccgtcagtcccagtccaatcaragtccgggagttattgttccacaataagccttaaaaaacacagaagatctctctccacac

SEQ ID NO: 537 - DNA, 121 bp, Gadus morhua
gtttaaaatcaaaagctcaatcttcaaaacaaaaacctccgtaaatatgactcaaatcggycatatgtcaaccattttgtttgggaatatatcaaaatccttcagttttggaccagaattc

SEQ ID NO: 538 - DNA, 121 bp, Gadus morhua
atcatagcaaaaaacaatatatcataattatatagcatgtatcataaggctaaaagtacartgcagtacgtgacattagagtccagctgtgaaggtatataatggtgtcaggataagcagt

SEQ ID NO: 539 - DNA, 121 bp, Gadus morhua
gtcctgaatatatgcatataacgaattgtcatacaatttatgaaacgtacaacgaagctgwgtaaaaaaacatacttaacatatgcttatctaaatggcttatagaatatagtctgaaaat

SEQ ID NO: 540 - DNA, 121 bp, Gadus morhua
gccattaccttccacggctccacgttttgtgatataataatccaaaggaacattcatcagyacccctcgtccttactgcagtgcagacgtctgaacagccacacatcatgtgaccatgcac

SEQ ID NO: 541 - DNA, 121 bp, Gadus morhua
gaagtcttgccaaagtaatgcctactccaaacatgcaacttactgatttttacaaaagtcmcaaagggtacagaaagtgcttaaaaggatcctttagtgtgtagagaatattttaatcata

SEQ ID NO: 542 - DNA, 121 bp, Gadus morhua
accctcagactaaatccaacacgttggacttagtttgggtacgttatatgaccagggtgtytttaataatagattcaatttatagcgctcttctcacactcaaagtgcttttttttttttt

SEQ ID NO: 543 - DNA, 121 bp, Gadus morhua
tttgttttaattgaacaagcaatgcgagattatttacaaacataaacaagagctcatgagyggttgtccatgagccgtctagtgaagaatttaagtgtgtgtgtgtgatttgtgttatctt

SEQ ID NO: 544 - DNA, 121 bp, Gadus morhua
gaatgatttagtggcacccagcggtgaggtagcagagtacaagcaactgaatcccccccgscacccctccctttataacgacatgggcggggcggacgcggattactggtcttaaaggggc

SEQ ID NO: 545 - DNA, 121 bp, Gadus morhua
cccctcatttaacaatagaagaagaaaggtcaccactgaagcaccttctacwatccccctracataagtaaaccgtcaccaaaaaacaaaaggccttatatctaaagtgaaggcaaaacaa

SEQ ID NO: 546 - DNA, 121 bp, Gadus morhua
tcagctggaaacgccaacagcttctctgattcttttacagattccttccacttgtccaccsctkctgcgatgcctagttctgtggaggcgatggcatccctgccagactgcacccgcttgg

SEQ ID NO: 547 - DNA, 121 bp, Gadus morhua
aatatacagcatatgtttgcctacagtatttatgatttaagattatctctagtaacccatycagtggctatgcaatataggatgaatgagccaatttgtctacatggatttcagccaataa

SEQ ID NO: 548 - DNA, 121 bp, Gadus morhua
gtaaagggaggtgccgaacagcttttggtagtccgctctgatatcgagcaagtccagctcygagcggctcactataattctggtcargatggactcagtcgttccccgggcccttcatccc

SEQ ID NO: 549 - DNA, 121 bp, Gadus morhua
ccctctctcaagtcagtcttatcccagsccttccgggtatcagaccatgtccaccagtttwaacttgccctcctgcaggttgggcaggacgttgatgaaggtcttgtagagaatcacgccc

SEQ ID NO: 550 - DNA, 121 bp, Gadus morhua
caggctatttctacaaggctatagcactggtgtgcgttgttaataccatttaaaactcctmaagtaatgcctcatgtgaatgtgtttctaatgcgctgcactggtaacacacattataatc

SEQ ID NO: 551 - DNA, 121 bp, Gadus morhua
tactaggtcttggtcttcacgcacagtgtttggtttgtttacagcctgcgcaaaacgtgaytcccggccaaacgttagcgattggttatggcagatccagtggcactgggcagatccatta

SEQ ID NO: 552 - DNA, 121 bp, Gadus morhua
gcccaaatatctgaattctgaatgttgctgttgttgaaacctttctccaccagccatcctmacacaaattcaaaggactgaatcaaggcacacttcagaagcacggacactaacacagtgc

SEQ ID NO: 553 - DNA, 121 bp, Gadus morhua
aacaaaccccattgccatttcccagtattctaccggcatttcaaatttcccttcatactgygcatacgacaaagtacccacgaggcctgtgtaaacatgatgtttttttgatacatgaaga

SEQ ID NO: 554 - DNA, 121 bp, Gadus morhua
ctccacccgacccccttgcacactgtaactttgaaccatacaggccaaagagaagaaaagrgaatggacatgttgctacaacaagacacaaaaacatgtagtacacctgaagcacaactat

SEQ ID NO: 555 - DNA, 121 bp, Gadus morhua
tagtgcaagcacatattctggtatctcgaccgatttaacagactggaaaagaaaactagtyggaaaatgggttaaatagtaatgatcttcccttccctaaccatgacaactaaggttccaa

SEQ ID NO: 556 - DNA, 121 bp, Gadus morhua
catatggggggggcaaaacgatggcattgcattactgaaaatcaatcatcttatccaattrtcatgaaaatacaattgaacatgaaaaacaaaaatgttttctttagtcgtccagcaattt

SEQ ID NO: 557 - DNA, 121 bp, Gadus morhua
aacaacagatacatacttcatcaactgtctttttaaaagacatacatgtggaagtatcacragaaatgatgcgggggacagttaaatgtacatcgtcyttgacatcagtcattaaacacac

SEQ ID NO: 558 - DNA, 121 bp, Gadus morhua
ttaaaacaaaagttataacagtttattttatacacaactatttaagaggttataagcctawtgacagagagccctcatgcccacttcacaatgcaaatatgaaaaacggagaagagcagga

SEQ ID NO: 559 - DNA, 121 bp, Gadus morhua
ccattgtacagcactgtttgtgtgatttattataagtcaggcatatcaacatcctctcacrcactcattcacacacacacacacacacacacacatctgtatttggccatggcatcaacag

SEQ ID NO: 560 - DNA, 121 bp, Gadus morhua
tgaataaagcaaaatttcaattgaatatcagattctaaactgcctaaataaatacaacatytacattcacttttgaatcaaagaagcaaccgcaaaaactaaacaaagttgaaacagacat

SEQ ID NO: 561 - DNA, 121 bp, Gadus morhua
taccacttcatcaagtagaacggactccagaaatccaagtttgagatctggcacagtgtgmcttggacaacaccatgtcttgtatgttttccttacacagtctgtcagaataccgtttata

SEQ ID NO: 562 - DNA, 121 bp, Gadus morhua
gtcccaacgtctcacgctgggtcgaggaacacggacaggatgacacacgctttacaacaakgacacgtgggacacgttgagaaacaaacaggccggtggctctcctgtgtcagtgctgtga

SEQ ID NO: 563 - DNA, 121 bp, Gadus morhua
cactctttaaaagggtgtaggatggtggtgctgaatcgatgagagcatttcaagcgagtcracttgttcacaagaatccttttgactaagacacttagaaacaaaaagaaaaggacagagg

SEQ ID NO: 564 - DNA, 121 bp, Gadus morhua
gttcctgatttagatgttgcatctaaatcagttcctgatttatgttagttacacttgaggrtactattcgtgacagctccagttatctgttgtgctctcagctcggtgataaactcctgga

SEQ ID NO: 565 - DNA, 121 bp, Gadus morhua
tacacagagtggatttttcctttacattttgcaaattttcttcttctgtggaaggcttagyttcccggccaatcagaatacatctgatccgttatcgaaagcgagtgatttaattcaagga

SEQ ID NO: 566 - DNA, 121 bp, Gadus morhua
caggtttgatttacgtttctcttgaaaaaccgttttactggaaacagtggtgctgaatcckgttgcacacatcaagcacgaaagaaccttgagtaacccctggagcagccattattgcaca

SEQ ID NO: 567 - DNA, 121 bp, Gadus morhua
gtatgacagcctgtacacttcaggcaaagaaagcaaaaggctatcggtgtaggccacgatrtacttaaacccctagaatattattgggtttgtcaactgtatactccagaattcaatacac

SEQ ID NO: 568 - DNA, 121 bp, Gadus morhua
tttggcagggatgactgatggggtctaacaacctaatgtagatgaaaaaaaaagcctaaartaataaaattaaaaacaagaacaaggcgaaaacattagcagtccacagtcttccacctcc

SEQ ID NO: 569 - DNA, 121 bp, Gadus morhua
gaaggctaacacaaaagagatggactaaagatgtaacaaaaaaataaatcatcgaggcaayatgaaaaccacagtatataacaaaaaaagaggcaataaaacgtcaccacaaatcatacaa

SEQ ID NO: 570 - DNA, 121 bp, Gadus morhua
attttaacaaaataggtcctcctgccaagcattattcaatcctatacatcagttttccttygtcattgacagaaatgaaactgcatcccttaacaaaatgttgaaattcttccttttcata

SEQ ID NO: 571 - DNA, 121 bp, Gadus morhua
tcttcagtttgtcacactcacaatacaaatgcattaatgtctccggatcagttttgcatayatcgcactcccttcttacatccttattcatttggtgtatcaccacatttgtgtacagtct

SEQ ID NO: 572 - DNA, 121 bp, Gadus morhua
agaacaataaatatactaaatctgactggcggagctccaacatcatattctgacacgatgrtgaatcatgtcaaagcagagcagtttcccagcagctgattggccaatctatacggacaac

SEQ ID NO: 573 - DNA, 121 bp, Gadus morhua
gacttctcgtgaattcccaattaggtccttagtggagcagtttaagggggttagggtatcytgctgaaggacgcctacaggttaggctgcgtacttttcggctgggagtcggacaccctag

SEQ ID NO: 574 - DNA, 121 bp, Gadus morhua
ggggttttagcaaccgagaagcggagtttggcatggtcgttgcatccgagcagcagtattrgttaataagagtaaataaagggttttgtaaacagtgaacagcggtaaggcagctggttac

SEQ ID NO: 575 - DNA, 121 bp, Gadus morhua
atcatagtgtcgacgcttcaaattctggaatcattcgagtcaaaaagaaataaaaaaaacragaaaacaaaaaaataaaaagggattggttgcttagttcagatgtactgtggcgtcaggc

SEQ ID NO: 576 - DNA, 121 bp, Gadus morhua
cggggggcccctttctccacaaagagcttcagagtgggctataggctatgttacagtcagrtgggaccatttggaagaggtcgacggggcccactttacgcataatcaccgctcctagatc

SEQ ID NO: 577 - DNA, 121 bp, Gadus morhua
ggaaggtgaacagaagtaggcatttaatgaaaagtttacaaaacaaaacagaaggcagaawatgtttaggggagaaataaacctggatctggattgataacgtggatagtggatggattta

SEQ ID NO: 578 - DNA, 121 bp, Gadus morhua
ccggcttcggtagcgcatcgactctactggccggggatcgaccactgctgttaggaagagyagcgcaaaccatccaaacgacgctttatcttcatttgttacacatgttctacaactaaaa

SEQ ID NO: 579 - DNA, 121 bp, Gadus morhua
ttgtcgttaaatattctttcaggggaacattcatcccaaaaaccacccactggatttgaargtcacactcagacaagggacaccgatcatttgatacatttggtaaaacatttctttgatt

SEQ ID NO: 580 - DNA, 121 bp, Gadus morhua
accatgacccaaacaaaaatagaagtcaatctccctgtcatggccttcaactgagctgtcrttttccagttttaaaacagataagaatttcagaaaacgcttggcttaggtgttcagaaca

SEQ ID NO: 581 - DNA, 121 bp, Gadus morhua
aagtcaaaactgcactgaacacaagtttcattgacggtacatgcagagaaatatataagcyatattctctgttgtgttcataaccacatttttatctggtgaaagacaatggacaattgcg

SEQ ID NO: 582 - DNA, 121 bp, Gadus morhua
cacacggtgtttcaatactccacaagttagaatgcatgagccgaggagaacaacagatatrctgtatgtaattcctactaagaaagagaaaagagtgagcaggagaaagacagagagagat

SEQ ID NO: 583 - DNA, 121 bp, Gadus morhua
aaagacagagagagataaaaagggagacggaaattctcattgaggttccggcgtggtgtgkgttgaatatattgtatttttatacgacgttacatacgtaaccttggtgtcgttggatagc

SEQ ID NO: 584 - DNA, 121 bp, Gadus morhua
attagatattcacaaaaaaaaatgtacatctattaatagagaaataagtttatctttgccygtttattgcaaaataacaatttgaatgctctccaaaataacttatttttttaacagccac

SEQ ID NO: 585 - DNA, 121 bp, Gadus morhua
catgacaaatcagaagtgaagtgtgtggcatcccaacatatggtcatgtagatgtctttcyaaatctcaaaacagtaccaaacaatcatactcaaatgttcttcagacagcaggcgtagtg

SEQ ID NO: 586 - DNA, 121 bp, Gadus morhua
ggttctgacatgagatattttaacttgaaccataatctctccaatttaatcttttcaaagrcccctgttctgctctgagatatgaataacttaagacaaggatccgtagacctaattatgt

SEQ ID NO: 587 - DNA, 121 bp, Gadus morhua
aggtggacgactagctactgccaagtaaaagctggcacacactcacacacacgcaccagamagagagctataattcaacagaaacttgcgaagaagaagagtttcacatgaaggtatctct

SEQ ID NO: 588 - DNA, 121 bp, Gadus morhua
acctcttgacacccatgtcccgggcattaccaattattatattccttaatttatttgamcwttaaaaccaagaaaaacttaaaacgaatacaagaataatttaagtacgttgttcaaaatg

SEQ ID NO: 589 - DNA, 121 bp, Gadus morhua
ggkacattttaaacattgcgcttttccacccactgagggtttttatatggtgtagtgacayagctgacaagaaaatctgcttgtatcttattattatttkgatttttatgtaattattatc

SEQ ID NO: 590 - DNA, 121 bp, Gadus morhua
ttatcttttatataaaattggggttaatgttgcatttctgtaacaccaaagtagcgtcacrttggtctaggactgtacgtgtgggctaatagtaaaaacattttaaatatgaaagaatttg

SEQ ID NO: 591 - DNA, 121 bp, Gadus morhua
ctgcacttgtataccttattactactttgtatgttaaaaatataataaaaccacagtagtygtgtctaccaaagtctttggtgcccacctttctgtaaagtgcagttcaaaacgcgccact

SEQ ID NO: 592 - DNA, 121 bp, Gadus morhua
aggcagacgttgtgcattgtcactttaacttaacgtttggacacccaaatgatatcaagtwcagtgtcttagaccaggcattaatcctgtgctgaattaagataggccctatcgattaaag

SEQ ID NO: 593 - DNA, 121 bp, Gadus morhua
aagctataggagtaaactcaacaaataagtcaacgatggtttcaaggtctgtgatatgtaygcgaagataagtggaaactcagggaccaatggaaaccgaccacctcttaacccaaagtaa

SEQ ID NO: 594 - DNA, 121 bp, Gadus morhua
gcaaccatcaagctaatcgttgttctgcgattcccatcagattcaagctcgataaagactwtcttcaccaaaaacagagacacatgtggaagttaaattcaatctttcgcgattacgccat

SEQ ID NO: 595 - DNA, 121 bp, Gadus morhua
gaacacgggtgccatgtcgacccataaagcatagttcagttaacacctaacattttgtctyataaaaaaaaaaacatatatacaacgaacgttgattgcagtgattcctcaaggggatttg

SEQ ID NO: 596 - DNA, 121 bp, Gadus morhua
acaccagtgttggaagctgtgagtacgttcggggctgcatgtcatcggacaccgaccggaratgaaccagcattctaggattcagtctgtgtcttaggttaggtgcgtttctcgcagacag

SEQ ID NO: 597 - DNA, 121 bp, Gadus morhua
accctaacgttccctggtttccgttaccatgactaaagtgctgttcctaacaaaaaaactkgtgaaaatcctccctcctaagcgtgtggaccaaccttacattctttttaaaagttgccac

SEQ ID NO: 598 - DNA, 121 bp, Gadus morhua
tttcatcagattatacacaaattaaaacatgattttagaacctttccaaatccgttccgcwacatgccactcaattacacacactgcacctttttaagtgcgcccgggtttcagttcagca

SEQ ID NO: 599 - DNA, 121 bp, Gadus morhua
ttgctctccaggaagcgcacggcggccagcgtcagaaccacggcctcgtgtttctagcatrctgtgcacgttcagcccgatggctgggatgatgttgaccgtcttgaggttggcggtggcc

SEQ ID NO: 600 - DNA, 121 bp, Gadus morhua
catatcgaaagcttttgaaacatacaaaagtgggtcatgaatatgggacggccatgtttawatgtcttcatgcggttattacaaacgcactccatagttcacatcaacgtgattcaaatcg

SEQ ID NO: 601 - DNA, 121 bp, Gadus morhua
atgtgtgagtaatttcctcagtatatacatatacgtagtcatatcttcacgagtaacccaracatgtcaacaaaataaaacaaatatgatacaagataagcttatgatcatagtttaaaca

SEQ ID NO: 602 - DNA, 121 bp, Gadus morhua
tacattgctactgtatgttttttttctcccttttgacctgtgaaattataagaccttccaragcttattcagatgaagagtacaacatggctttaacaaatgtatccacctgtattacttt

SEQ ID NO: 603 - DNA, 121 bp, Gadus morhua
ggccaactttgattgcacacagcaggaggttaacatatttggtattgggtgagctgctgcraacgtcatctttaatcggctgagccggcgagttcgaccatggagcccgttaacgtcaacg

SEQ ID NO: 604 - DNA, 121 bp, Gadus morhua
tgcatttgtgtatacctttttataacagacatatgtgacctcaaaatctctaaaaggttasggttggtgaacagtttttcccaaggtaatttccaaaccttcctctcttccgctgttctgc

SEQ ID NO: 605 - DNA, 121 bp, Gadus morhua
taccagttcataaataaaatgcaatgctaaaaaagtatcgccagaacacaaaaataggcaygttgattgtacaatctccattccacagtattaaaaagttaaaaggtaccatcccattaca

SEQ ID NO: 606 - DNA, 121 bp, Gadus morhua
ttcacttcgttttgccaagccaaactcaagccaagcctctgctttagtttgtaaaggtgamttcaatgcatgaaagcaacagcgaatgagracttcagaaacaatggaacaacaaggaaca

SEQ ID NO: 607 - DNA, 121 bp, Gadus morhua
tctataaagcatccagtacattaaggtttctatttctaaagttccctctccacagcctccrgtacattaaagtttatactttctaaaagtccctctacacaacatccagtatatttaggtt

SEQ ID NO: 608 - DNA, 121 bp, Gadus morhua
gtatggagtgacgggattaaatatagagaatttctttttatttctattctaaggagatatwtctggagttataactgagaaataacgcagtggacttaaattattctgattasgatttaac

SEQ ID NO: 609 - DNA, 121 bp, Gadus morhua
aacataatcgttcttctcactctgcaattcttckgtctgacttcagttcaccaccacaccrtctgtgtcgccaattctccttttcctccaaaccatgcgtacgcatgggtcagagtttgct

SEQ ID NO: 610 - DNA, 121 bp, Gadus morhua
tytcccgtcaagttgkttttttatagatcacaaccttggcgtgraaagtcacgtacgcmamtttcagccccgttttgtgcgtacgcaacggttataaatgagaccccagaacagtagacca

SEQ ID NO: 611 - DNA, 121 bp, Gadus morhua
tgcatggctaactcaggacagttatgaaagatattcagaatgttgcagaggttgacaccawagttccaaacagtcaaatgcattcacaacaataatgcatacatttttaatttaacgacag

SEQ ID NO: 612 - DNA, 121 bp, Gadus morhua
ctgccatggcgcgggcagacgccccccccasacactttttacattacgtctcccagaggcrccttcccctggtaggagacgcccggggaaccagagacrcagtgttcctgggttgataccc

SEQ ID NO: 613 - DNA, 121 bp, Gadus morhua
acatcgtaactaaggtgtgtgtgccgcaaggttttcagaccccaacagcttaggggatatkactagaacatctgttatagaatcactagcaactcataatgtaactgcaagcattaataca

SEQ ID NO: 614 - DNA, 121 bp, Gadus morhua
gcgctttattttgtctttctgagcccctcagggttgatggtctttccctcagtaacctccrcgttttctgtctagaggtggcatgtagtaggccttgagcccggcacgatgtgactcatcc

SEQ ID NO: 615 - DNA, 121 bp, Gadus morhua
tacaaaaatcctctcaagtgcttttaggcccacctgcttaaggcgcagcgagctctgacaycacaccggctcagacttccaaagccgaaagggttaagagaagcaaccgagagtgccagtg

SEQ ID NO: 616 - DNA, 121 bp, Gadus morhua
acagaggaaggcacactttaagttaagccctaccacccatttttaaatatcgccaaaaaawtaattttaatgtttttaccgaggacttcaaatcccgatccaactcaataagccatctatc

SEQ ID NO: 617 - DNA, 121 bp, Gadus morhua
tgtctagcgtgggctattcaaacgtccctactaagctgttcaaggttgggttttcgacgtrgttcatcggggtcacgccagtcagccttgttcggttcttcacttggctcgcctcttctcg

SEQ ID NO: 618 - DNA, 121 bp, Gadus morhua
tttcaaacaaataaatctacccaggaccaacatatttacacaaagggttcacaaagcttgraatgtacacaatacttaatataatgtgacctgggaaagaaatggacagaccaaaaaaaaa

SEQ ID NO: 619 - DNA, 121 bp, Gadus morhua
attttttcaaagtgtgtgtcaatctccaatttctgctcttccattyctttttgctgaattyccaagttagttgtctgatttctgtgcatccagaatcttctgctctatgaatatgcatctt

SEQ ID NO: 620 - DNA, 121 bp, Gadus morhua
cagaatcttctgctctatgaattgcatcttcattgtaatgtcttgatgtgtcttgttcaaycaactcttttattggcctctttcatatttgtgttgtgtcttatcgtttgcatggcctctt

SEQ ID NO: 621 - DNA, 121 bp, Gadus morhua
agtcatgtactcctggaaatccaccaaacttgtccttgttatggtccaggtcatccattaktttgtctacctcacctggttttggactgtcgctatttaaaccttttcagctcagtttgac

SEQ ID NO: 622 - DNA, 121 bp, Gadus morhua
gagcagaagaagaagggagacatgtaacgcattaacgcatagctcatgaataggcagaggyctctaccattttctgtctcacacagtttcacctctagagtgtttcgtttgaggtagaaac

SEQ ID NO: 623 - DNA, 121 bp, Gadus morhua
attccagagtgactaattgcaacaacttttcaactacacatacacaaaatgtcaggcaacygatgacagggaatacatgacccagaattccaggatccgttatgctagctaacttcaaaag

SEQ ID NO: 624 - DNA, 121 bp, Gadus morhua
ttttgcaatatataaatataaatctccaacacgccattatgctgatatgcaagtttaaaakacctaatgggaggagggagggcagaagggcttcatcctgagaggaagcgtgtctcagatc

SEQ ID NO: 625 - DNA, 121 bp, Gadus morhua
aaaaggttttacaagtattcgaaagacaaataactgtttcaaccttacccacagaaaaacmctttaaaagaaaaactcttgccactcttttatgaaccatttgcatttcagatacatgtta

SEQ ID NO: 626 - DNA, 121 bp, Gadus morhua
actctcagacactttggcaaagagagatcgttgaagacattttaaagcgttcatgtggtcmaataatcagaggacggatcactctcgttttaacctcaacacaacaaagctgctcgggatc

SEQ ID NO: 627 - DNA, 121 bp, Gadus morhua
ctggttggttattatacagacatacataacatattttgagaatcacagttagtttagattkcatcctatgtaacatttggaccattacaatattgatcttgaagttgtgtcatgggaatgt

SEQ ID NO: 628 - DNA, 121 bp, Gadus morhua
taaaacacaagctgccatatcatacatttatacaccaggatttgaaaaatcctataaaaarccaatgatatttgaaaatatgggtatcgatatgaaatatgaccttacatacaataatttc

SEQ ID NO: 629 - DNA, 121 bp, Gadus morhua
gaagtcacacttgccttcagtcaaaaagtaaagaaacggaatctaagaatccccaatcccyaatgtacagagttaagcagcaatgaggttaccacgattaaacaaaagcgaagtggagcgc

SEQ ID NO: 630 - DNA, 121 bp, Gadus morhua
aaggaggcgttgtacgctgaaggaggctgagttgtattggcagtctttatgaaatgtgcaygtcagacactccctttgggttgacgttccgttggaggtcaacttgtaaacattgcgggct

SEQ ID NO: 631 - DNA, 121 bp, Gadus morhua
ttagttgttatattgatatattaaagagtaaatgttcattcctttgtgagatttgtacatktttacatttgcacagttgccaagaaagtattcgtatagtcttgactatcaaatggaatga

SEQ ID NO: 632 - DNA, 121 bp, Gadus morhua
cacctcccaagcatcaaaccgttgtcagtaaattgcccgtcaatagagcagtctggacttkaatttatatacagcatatcaagggtgcatacacaaaatattcataagacaactcatgaga

SEQ ID NO: 633 - DNA, 121 bp, Gadus morhua
tgctttagtaggtccaacaaccagccgatagaatgaaggaagcccaggattcaaacagagyatagtgaaccacggagaaggaccatgagcagaagaaggtagataatacagtttggtaggt

SEQ ID NO: 634 - DNA, 121 bp, Gadus morhua
cttgtatacagctttaaacataaacatgaaagacattaaaaggtaatacttttaaaagagwttttgctgtaagtgtagacagaataacgcatggataagagtacaacgtattacaacaata

SEQ ID NO: 635 - DNA, 121 bp, Gadus morhua
gtgcaacgtactgcattcgatttggttccatcggggacactggctcataggtttaatcaayccactcccttagacatcatccctaaccgttcactggacttctggacctctggccgcctag

SEQ ID NO: 636 - DNA, 121 bp, Gadus morhua
catgttttattgttacrcaccaacagccacaacaaggcactttcagagcgataccaaaccmcgcgttatcttcagcacgaagcgaaaagctctgtcaaaacccaaactctgtgcattgcac

SEQ ID NO: 637 - DNA, 121 bp, Gadus morhua
ctacacctgaggtgtttaattggatatacttttgtatccgttataaaaattaatgatgaawagggtcgtacctaatgaagggaagttgctggccactgtgtaatctctttttcgtctttgg

SEQ ID NO: 638 - DNA, 121 bp, Gadus morhua
caatatacgatgatttaatgtcccttcagacttttgtaaaatgaacgtccgtgtttggatwtttttttttttgtctttttgtagtgttcattgttggctttaaaagaatgaggaacaaaca

SEQ ID NO: 639 - DNA, 121 bp, Gadus morhua
gaaataatgctcaaccctctgcaatagggttcatatgtctttcttaaggcaactttaaaawtgtttatattttagggggaactattgtaagtgcacgatatgtttttcatgctgcccttat

SEQ ID NO: 640 - DNA, 121 bp, Gadus morhua
acatttttatggtgctgtataactcccccctgctggtctgacggaattatgggactttacrcatttactgatagaagttggcaggattaaaacaaagttaggaatgttgtattacaatgtt

SEQ ID NO: 641 - DNA, 121 bp, Gadus morhua
ttctttagtaggagcttgatcctggaactgttgacagcttccatccctatacggagcaggrggtttcaaactcataaaagttcctcagacatgacttcatgatgctgttctgtccccagct

SEQ ID NO: 642 - DNA, 121 bp, Gadus morhua
atcatcagtcaggaagtcacggagattcagtccctggtgatggcctggggttttcctgagyaggtcgatccagtctactatttgcccttcttgtgtttcctcatgtacgccgcgatggagc

SEQ ID NO: 643 - DNA, 121 bp, Gadus morhua
atgcttagtacaccacctgcccaaccttctgcagacgggcgatgagaccgcaggggacaaracaaaagatatccacgggcccggatgaaaaaaatgtgtttgtattattagaatattatgt

SEQ ID NO: 644 - DNA, 121 bp, Gadus morhua
aatgggtaagcctaatataagataagaaaccacattcaattaaagacaatcttcaaactckgtattatcaaatctacacaaatataaaaaaagaacgataaaccatgtaaaaaataggcta

SEQ ID NO: 645 - DNA, 121 bp, Gadus morhua
aacgatagtctcctcacctgcattggattactcaacacatcgctatactgcaaccccaccmgctctcttcgcctggagaacccatgattgcaaacatcttaaataaagtgaaacacagccc

SEQ ID NO: 646 - DNA, 121 bp, Gadus morhua
ttgttaacttgagagaataacagatacaacaaagtgtaggaagaaggtcgaagcaaagcastatttatttttgactagccgacgctacacttccatttaaagttgtcaagcctttgcaatg

SEQ ID NO: 647 - DNA, 121 bp, Gadus morhua
aagcgcttgccatagtaaagatagcagttccctcgtccatcctgcaaaaccaagtacagtkgtctccgtggaaaccatcagcgagacgagcatcacaggggatccagattaggtttcttgt

SEQ ID NO: 648 - DNA, 121 bp, Gadus morhua
tgatggatacattctcttattgattaaaccgttcttcaattttgacccagaaaggatcagkatttgaacgggttcaacataatgcgtaatatcaaccttcaaaacaatatgtgcctccaca

SEQ ID NO: 649 - DNA, 121 bp, Gadus morhua
gactcttgtgccaatgttttcacccaagtcttgtgccagtcttacagctctggtgaatgargtgaagcgtacagctacacggcacagcgccctcatgcccagaggtgttccaacccttccg

SEQ ID NO: 650 - DNA, 121 bp, Gadus morhua
cccctatttgttttcaatggaaacactcaatcaggagtcaatatgtaaccagggttttgcyagaccaaaagcgaaatatcggaaaatgacatgttgcgtcgcacgaatcgcgtggacctca

SEQ ID NO: 651 - DNA, 121 bp, Gadus morhua
atcatgcactgacacatggaatagttactatcgctagcaagcaatatgcattcttgacaakatcagggaacacagatttaatcaaatgcagtaaagcaatggttgtcaccaaaacgtcttg

SEQ ID NO: 652 - DNA, 121 bp, Gadus morhua
caccgctagctagtcaacatatcagctacactaaaggaatgatcatcatggaatgatgtcmaagaacagcaaggcatcatcaagtataaaaagtgcaatcatttaattccaagcaaagtaa

SEQ ID NO: 653 - DNA, 121 bp, Gadus morhua
ttaaccaaatacagcttaaccaaacacatccattaaccaagaagggatcacgaggtgtgamagtaacaaaatgatctgcaaaaacaaaggaaagcgaacgtaacgattatcctgagaattg

SEQ ID NO: 654 - DNA, 121 bp, Gadus morhua
ttatgaaagctcttcaatggcttcaagctggtaagacttaaacattcttaacaccgtgcawgtaggtgtagtgtaagcggtctaagttgaacacggcagaacgatgtgtcattcaataaag

SEQ ID NO: 655 - DNA, 121 bp, Gadus morhua
agaaaaacacattgtatccgggtttaaaatgagggctgccctctcatgtactccattcatwggccaataaaacgaagcagcctccatctgaggcaacaccttgactcaatggacatcaacg

SEQ ID NO: 656 - DNA, 121 bp, Gadus morhua
tgtagctttggccctctaagagccaatcagagcaaagaaaaataacaaaaaaaggcctttkggcgacccatcagtataaccttaaataagggtctcaggctgtaatcacatgcagaactaa

SEQ ID NO: 657 - DNA, 121 bp, Gadus morhua
gaaattcacgcagatgagcaaatttatgcattttggtgaaaaccatttttcttcttgtccrcattatggggcaagtagcgcaaacttgcgatctccggtccttaaagtttaaaatcaggaa

SEQ ID NO: 658 - DNA, 121 bp, Gadus morhua
gttcagttctacagggaacactttcaacttgtaatctgtcagtcataaactccaaacaatytgtatcccaaaggcttctaattttggcgtcctgttactgtgtgttacgcaatcctccttt

SEQ ID NO: 659 - DNA, 121 bp, Gadus morhua
actttgtttcaggcatgtttctgtaatggctcacgcgaggcatttaacatggcatttccamaaggcaactatttcttaaggcaatcagtgagcacattcttatataaagataatttcctcc

SEQ ID NO: 660 - DNA, 121 bp, Gadus morhua
aaaaacagacaaaacttaaaatgcactaatttttcaaaaacgcctctytgaacaatcctgyctccgctggcccagaagaggcagattgaacttgcagttaaaagcgttgagaaaagtgagg

SEQ ID NO: 661 - DNA, 121 bp, Gadus morhua
atgttacctgtatttgtttttgacaaatatgcyttatcacaggggtactacataaatatgragggttatgttatgtcatgttggggaacaataatgacactttaaatcatgattaatatcc

SEQ ID NO: 662 - DNA, 121 bp, Gadus morhua
ttttttcttaaagcagaaatgttcccttgtagtcacacacaaatacaggcaaaaggaaacragaatcatgattctcctctaagcgtacacttgaaatactgttaaaactatagatctataa

SEQ ID NO: 663 - DNA, 121 bp, Gadus morhua
cattggaaacattaaatataactttccaggatgacaggacaggtacattttatgcatattkatgttttataaaccccgacccctccccaagtgctccaagttgaggagtatccccatcctc

SEQ ID NO: 664 - DNA, 121 bp, Gadus morhua
gccttacgaccgaacccggccaccaggacctcgtcgttctcctcaatgaagttcagacaaycgtcattagggacgaaggcggtgatcttcttgccgttcttgatgagctgcaccctcacac

SEQ ID NO: 665 - DNA, 121 bp, Gadus morhua
taacatgcaatcaatgagatattaaataaatcacatttagaaccccaattggcaagttctkctagcattaatttccaaaaggacaaacgattgattttacagttgaaaaccatgtgatgct

SEQ ID NO: 666 - DNA, 121 bp, Gadus morhua
ggcgctagatgggtttgggagtaacaaaaagaaaacatatttagttgtaagcacaggttartgcaggttgacaaaaggcatttttgccagtttttctgttctgctacaggggcgtaaatta

SEQ ID NO: 667 - DNA, 121 bp, Gadus morhua
tcgagtggagaggcttggggcctgataggcagccctcatcgcacgccttgatccttcagcyggcgagttgagctgaggggtggcgataggttgtaacttggattccacgcatggagttcgc

SEQ ID NO: 668 - DNA, 121 bp, Gadus morhua
tatagcaatttttattgttttacgtttcttatatatagaaaatcactatcaacgaacagtycacaccgttaaaaaccaaggaaagtaaggcttataaaagagtataaaaattaaattgtgt

SEQ ID NO: 669 - DNA, 121 bp, Gadus morhua
catgatgggtgatctttagtagcagtgacaactttttattcaacgttgcctattctggatwcttagttgatgaccaaatacatctcccacaaccagtggtcataagagtgttgcatacatt

SEQ ID NO: 670 - DNA, 121 bp, Gadus morhua
gttcacttgtacaacaattatcataaacaaaatattatgtcacaaatggtgcaattgatgrcaataaacttacacttgccatgctaaaatttgatgacgaacctccattttccccccagat

SEQ ID NO: 671 - DNA, 121 bp, Gadus morhua
cacaaggcaagtgaggaccaacaggatgagtgcaaagtagaggtagtggaccttagctatmaaggggggccgtaggtcctcatggccacaggaaggaactgtactatatgaattctagaac

SEQ ID NO: 672 - DNA, 121 bp, Gadus morhua
aaaccacacatttcatgtttttcaaccaaagtgtgggaaaaccctttatagctttcttttktttattcatcaagtaacctgtaaatgtgaataactcatttaattcaaggggcaaagggta

SEQ ID NO: 673 - DNA, 121 bp, Gadus morhua
aaaatgcccaatggaagtgtttgaatctctctcagtttttgctagaaaatgtttagcaccrtgcatcataataaccactgatgaacataatgaaatccaaatgaaatgaaatcagaaatgc

SEQ ID NO: 674 - DNA, 121 bp, Gadus morhua
acatttctcatgattctgtcctaataacatgtatgctgaagctgcttccttcaacactcamtatcatttaagagttcaggaatcattgtaatcaatggcttcggggctttaagggcattta

SEQ ID NO: 675 - DNA, 121 bp, Gadus morhua
cgccaattgaattcacaatctctggtgtttcacttctggttcttttcagatgtatctagtrcctagcatgacattttacttctatacatggatatagattatctttaagctgtcacctggt

SEQ ID NO: 676 - DNA, 121 bp, Gadus morhua
ttgctattatacggtgggttataattaaaaaaagaaaaatcattatgcacaatatggtgtrcgaacaatgtactgttgatgtcactgaaacccaggaccacactttaaaagaaccgtcaat

SEQ ID NO: 677 - DNA, 121 bp, Gadus morhua
caacatgtgccttgaacttggtagaaacatttttttctgcgcaaatgcatataggagaaasactgtaataacccgttcttgtagacaatggaacaataacttgtgaacacakataaaaatg

SEQ ID NO: 678 - DNA, 121 bp, Gadus morhua
cattctgcagattgtgttccttgtaatagtttccattaaaatgatttccagtggtgaaagmcaacatgcaaaggtcttgcccggctttcaaactttgactgcttgaatcattttccactag

SEQ ID NO: 679 - DNA, 121 bp, Gadus morhua
acgggaacaggattgataaatacaygggggatggaggtgtggggcttctaagggtttatcmtgttatcaactgcaattaatatcctgtcaatcaaggagaggctcagcctagaggaacgcg

SEQ ID NO: 680 - DNA, 121 bp, Gadus morhua
tatttcagaacaaaaaccaacaatatgtacatccaaacagtaacgtttcatccaaaataawacccaaagggaccgtaaaacgtgttcacggaaaacttagaacaagcagcaggcatctgtt

SEQ ID NO: 681 - DNA, 121 bp, Gadus morhua
aactggtcctcctggcatctccttttagttttgctcctcgatactcacgtttgacctccgscacatagtggtggtccttcccatgggttacctccatgatcgcctgtgccttcttcagagc

SEQ ID NO: 682 - DNA, 121 bp, Gadus morhua
gtaggatttacggttttgaataatccaacttcaatttgaggccatgttccctttaattatrtaggcgggtaatatgtttagttcaatgccattccgaggagactttctgaatgaacttgtg

SEQ ID NO: 683 - DNA, 121 bp, Gadus morhua
tgtttacctgtacggacaaataaaccaaatcaccagaaacttcttggggaatgtttaataycatttcattgttttatttctcatagcaaatgggaaaatataacctttatacaaacgtctt

SEQ ID NO: 684 - DNA, 121 bp, Gadus morhua
gaaagaatacgattaaatacaatctgataaattagttaaagataagactaacacgtaagcrgggctagcgagccctctttgcatcgctgaactgcacttcatattggacatatgcatatga

SEQ ID NO: 685 - DNA, 121 bp, Gadus morhua
gctgaagaacaggtatttaattcacttagacagccaagtcatatgtaacagtggggccacracagcactgtctacaacatcaccagtggcaaaacaaaatggtgggaacacggtggtcgtc

SEQ ID NO: 686 - DNA, 121 bp, Gadus morhua
ggggcaaagaccttccgtttctgaataataaacatcgggaataaagtgatatgaacagctrgatcttgtgaaaacacgttcaccattacgttacagggtcaacattagcagctagaatgga

SEQ ID NO: 687 - DNA, 121 bp, Gadus morhua
ctacgtaacaaaaagctcagactcagatgagagatcgcttgggttataagactgatgtggytgaacactaagctccggtaactatggaagggtgcgtgatgcgtctttctgaatgatcagt

SEQ ID NO: 688 - DNA, 121 bp, Gadus morhua
tttaccagcaaaccatcgtccatgaagggcattaacggtagccatcgctgcaggtatggargggcattttacgtagacatttccttgagcagagttcttatcgacgtatgtgtgaactatt

SEQ ID NO: 689 - DNA, 121 bp, Gadus morhua
aacaaaattcacccggactagcataagcccctcatcagatctccaaaatgtggagctataktaaaaggcactgctttaatgtcagattttccttgcacagagcaaaataatgtaaaacaaa

SEQ ID NO: 690 - DNA, 121 bp, Gadus morhua
tttactacacaaactaacccgttaccatgccaamctaccattcagggggtggtgggggcaygtatcatggcggtggagagctaccctgatgacaagtccacttcaaggataccaagaacct

SEQ ID NO: 691 - DNA, 121 bp, Gadus morhua
cagttggaaacacagaagacattgcattgttgtattgcaggaaaaaaaaatacaaaggctkaacaatagaaaccagaccaaaaataaaaggcaaaaataaacatgtcacaagtctaaggca

SEQ ID NO: 692 - DNA, 121 bp, Gadus morhua
caagaattcagccagcagttgcaaagggcttcctctgatgaaatctgttgtccacaatgcyaatggtagttttcggattttcacgggtatttcatgctgcagtcatatactccaatttggg

SEQ ID NO: 693 - DNA, 121 bp, Gadus morhua
caaaaaggtgacaaaaattaagctcatgagaaaaagtggacattaacagcaaacaaatgtwcaaaaagcagtcaatggttttgaggcctctttcaaatggcttctccgggctccgtacaga

SEQ ID NO: 694 - DNA, 121 bp, Gadus morhua
ttcacacccttgaactgaacagggtacagaatttaaatggtaacccaaaaaatctatttdkgttttgtcacattctgagagaacgcagaagaccaaggatcaatcctaaaaataaggggga

SEQ ID NO: 695 - DNA, 121 bp, Gadus morhua
cacatwttggatgtgaataatatgaatttgtagctattatcttgaatgtgttgtattgccrtgcattgcattacaatattttcatattttagaaaagctatcttgcaaaaaatggtaacgg

SEQ ID NO: 696 - DNA, 121 bp, Gadus morhua
taaaagataattatatgatgatgcactctagtcactgtgtctgtctagtagtgacacatcwcttgattgaaaccaaccaaactggtcagcttcaaccacacaacttgagaaatccatcagc

SEQ ID NO: 697 - DNA, 121 bp, Gadus morhua
gtggtccgaccctgaatctgcaggaattatgtttctagscccttcctaggccgagaaaatmacttaaaaccgatccaaattaattgacgtatgtttaggttattaaaacatagaagggaga

SEQ ID NO: 698 - DNA, 121 bp, Gadus morhua
tcaaaaccatttcatttatttggcctgctctgcaaatatccgcagtttaattcgtttacawttgtcaatgttgagatgtaaatcttgcattaaggttttcctcctaaaatagttaaaaaaa

SEQ ID NO: 699 - DNA, 121 bp, Gadus morhua
tacaggcacagtcacagtcacaacgccagctaactccccccgtcagaaaggaccaggtcarggtattcaacgtcacaaggagagcggaacaagggaggaccactttaccccacacacttac

SEQ ID NO: 700 - DNA, 121 bp, Gadus morhua
aaaaaacaaaacttccagcaaatagtaagatggagcataaaacaatccctaaaattaggtmaatcagtaaatgaattgtcaaacaaatggtatagcccatgacaagaaggttcttataaac

SEQ ID NO: 701 - DNA, 121 bp, Gadus morhua
gagtggtattcagtaaagaaaaagcagtacaggaagttgtatttcgtggcaaagttttgcycagagattttccttggcacctgagattaggcagttacattggaggggggaagcaacttca

SEQ ID NO: 702 - DNA, 121 bp, Gadus morhua
caacgggcagtggtactagtactatcattggcagaatcaataggagcttgctaaagacaaktaggtgagagtagaccagtgatgcccttgaagctacactttcaaccaaaaggcaataagc

SEQ ID NO: 703 - DNA, 121 bp, Gadus morhua
ggggtaatggcatgacactggcttcctccatcttctgcgtcacctttttaaataaatcgcygtttcttgttttccgacggcgacaaccataaacatatgaatagactattcaatatttata

SEQ ID NO: 704 - DNA, 121 bp, Gadus morhua
tccctgaagatcccgttcttcaagtatgtgagtacagcatatctcagttcataagagcccwaaactctttaataatgtatcccgaggcacggtggagtcaaagacccaatcagaacacccc

SEQ ID NO: 705 - DNA, 121 bp, Gadus morhua
gaattaaaatgaataatatctaatctctaccctgttatcgaaattccaccatgggagcaayttgtctgctaaaaacgtagatcctttaccgatacccacggtgtttcatccattcactgga

SEQ ID NO: 706 - DNA, 121 bp, Gadus morhua
aggataagtatatctatatttgtagttgaccactatgaataatcaatacatttaacagacrtataatatatatatgagccattaccaccacattttctttccaacactggtacaatgaagt

SEQ ID NO: 707 - DNA, 121 bp, Gadus morhua
acagtacctcctactgattggctgagcagacaaaccgttcccctaatttggtcataaacayggtggaggcccctctctgcgtctcccattctgttttggtcactgaaaaaacaagaaacta

SEQ ID NO: 708 - DNA, 121 bp, Gadus morhua
ttatggctaaacagtagttactactcagatgctgagagaaaggagtcaaattagtctaaaktcctttcatgagagagcaccagacttttatttaaactgtttacatgtttgagtgaagtca

SEQ ID NO: 709 - DNA, 121 bp, Gadus morhua
ttaccagtatgtatttttcaaaaataagacctttgattcaatggttaacttataatgccargaaaaatgccagcaatcacctggttaccaaataaaaaccatttatacaccaatactttta

SEQ ID NO: 710 - DNA, 121 bp, Gadus morhua
ttgcagtattcaggcattgtgtttcaatttcctcctcaagcccatataccactactaccgytgtggtggtccattctgcgtgtcccccccagcccaaccattttatcttttgtttttcagg

SEQ ID NO: 711 - DNA, 121 bp, Gadus morhua
caaacacttccgggtttataaagaattaaaaaaaactatcgttagggttaaccatgcctamatatccgtttctcctggatattacaatgggacgtatctatcttctcattgtttccacata

SEQ ID NO: 712 - DNA, 121 bp, Gadus morhua
tgtatatattgtataattttacatataatctttccaaggggagaattgaatagagatccamgatataacccctttcatttatcggactataattcacacgtgacatttctcatagcacaca

SEQ ID NO: 713 - DNA, 121 bp, Gadus morhua
ggtgcatcgaaggaagttacccagatctaaccaggtacatttgactttaacatgctaccgsccaacaacaagcatctgcagaacgctgatgccacaacagcgacattatacaacctatggg

SEQ ID NO: 714 - DNA, 121 bp, Gadus morhua
cacgtgttgctaagcaacagacaacaccattcagtacattgcacaaccttgctaagcaggrttcttcgatgtaagagagtttcaccttattctttttttgacacttaacatccagtcaaaa

SEQ ID NO: 715 - DNA, 121 bp, Gadus morhua
acgacggagcaacatgagtagatctacttggagagacggtgaaatcagcgagcttctgacyataatggagaaggtgatgccggtcgcatttaacgaagacggttgaaagatggttccactc

SEQ ID NO: 716 - DNA, 121 bp, Gadus morhua
gtgccatgaaaaagtgcttcattctaatgttcttcgttgtacaggtttatcacgtgagaaragcaaaatccagaacaaaataacccagcaaacaaactaacattaaaaaaaaacacctcgc

SEQ ID NO: 717 - DNA, 121 bp, Gadus morhua
cagacaatttgatttctggtayaggacattggaacagtttggagtgccttacaggagtagwagcacagaggtaaacaagatgtgaatgatcaagtcgactgcattgggaggatgggtccat

SEQ ID NO: 718 - DNA, 121 bp, Gadus morhua
gatgacgggcacccatgtcgcggtagcactgtgtgacagctccagaggtggtcagatccckgtactctctgtacatgttgtgggtkccactacgagagtcataacgcagccagataccgaa

SEQ ID NO: 719 - DNA, 121 bp, Gadus morhua
gcatggggagggtagccgttgctaaccaccagctgagctacaaaacgcagtaaaacatttscttttcttagtttcttagtgggagagccgatgacctgaaggttcctctctaaagcagaac

SEQ ID NO: 720 - DNA, 121 bp, Gadus morhua
tactaaaacattaagccatacaactccatagcatcactgctaggaatacacatcagtacayttcaatccaccgagttgatgtcccacactgatgacattaagcatggatttgcattgcggt

SEQ ID NO: 721 - DNA, 121 bp, Gadus morhua
tacatgaataattttgcgcaaatgagtgatctctagagattgttttgggttttcatgagcmaacataaggacatctctatacccatggatgatttggaggaagcagacagaggagacgcag

SEQ ID NO: 722 - DNA, 121 bp, Gadus morhua
atttattgcctgagaaggaaagataatttattatacagacagcaaggggctcattcacatycattgaagggttataactcatcccgtttccatagagatcccggggctcctcctgtgggct

SEQ ID NO: 723 - DNA, 121 bp, Gadus morhua
gcatgccattcatagctatgagttatgagttatgagaaaacaaaggctcctatatcagtgrtgcactttctcttcagtgaatcggatataaaaaggttaaataaaaaattataaagcaaaa

SEQ ID NO: 724 - DNA, 121 bp, Gadus morhua
gtcgctaagaattcggccaaccactgtcatcaaaacctgtttgttaaacagaatgtcccawaatgcaacaccggtatgattaattcaagacgaaggtaaacataaacacatgacatagcaa

SEQ ID NO: 725 - DNA, 121 bp, Gadus morhua
cctacatatttggttgtgtagaacagaagcaaccgaacaatgaaaacctgatggtcagagracaaattgcagacagaaaacaatatttctgctaacattaatgcaaaacgaatgattgcat

SEQ ID NO: 726 - DNA, 121 bp, Gadus morhua
taatatttatttcttaggtagatcccctctaatatccctgctgagtcaacacacataggcygtattgtctcttcggccccgttctgtgtgggtgaggggcgtgtccttaagcgcccctcgt

SEQ ID NO: 727 - DNA, 121 bp, Gadus morhua
ttcaaaggagactcattagtagcctgattggttatatttacagtcatctcaaaatgtcaaraggttaaacattgaacaactggctcatgtgttcacaattacwgcttttggcgcatcaatg

SEQ ID NO: 728 - DNA, 121 bp, Gadus morhua
ctttggaagaaaaatgagatcaaacgatatctacattcatggtgtaggggtgatgtcccaraatgggggcccagaacagtgtgctgcagtcacgtcatatagtatgaacacaatccagaaa

SEQ ID NO: 729 - DNA, 121 bp, Gadus morhua
ccatcctcagaaccaccccacattttcagaatcacttgcccccaccaatttgacagcgtartaatccacacgtattcaacatgtatatatcaaactatgacgattcacatcatcacttaaa

SEQ ID NO: 730 - DNA, 121 bp, Gadus morhua
ctattcaaacaattgtgtgagaatacttttaggcagtgtgtgtcttagcacttacagacamagtggtgcgtgctacttttgagaaaccatttttttaaatggctcaatttctcagaacagc

SEQ ID NO: 731 - DNA, 121 bp, Gadus morhua
acaaggccctcctacacaggaaggcccgtgggtatactgtgtggccttcacttcctctccrccttcaccttggggctgaagaaggcggacattgtcttcatgccagacttgtccactttgg

SEQ ID NO: 732 - DNA, 121 bp, Gadus morhua
tgttgaaggcactcccactcactcttatgtaacataaaatcaaaaatcctacgtagcaggscgagcacagttctatgcaactagaagaaacaatgagctaaacaattcacagtgtacgtag

SEQ ID NO: 733 - DNA, 121 bp, Gadus morhua
aaggcaattatgcatcaggaagcaaatatacattaagcatcaccaccgtcacagtaaaatktaagaagatcaactccatctaagacttctttagagaatactgacaaacaacttaggtcaa

SEQ ID NO: 734 - DNA, 121 bp, Gadus morhua
gtaaaaacacttgtgagtcaactgatgcatatgttgcgatagaaaaccctgacatttcackcaaactacaatcacactgtggatatcagacattgtttttccatctacatttcagaaataa

SEQ ID NO: 735 - DNA, 121 bp, Gadus morhua
agtgaccaaacagaagaagtaggccgtgtgcaaacaagagaggtaatgcaattaatcaatrcacacacaagtaccataattccccaggatatttgcargcaaaatgcgtctctatctctca

SEQ ID NO: 736 - DNA, 121 bp, Gadus morhua
gaaatccaatccaattgtgccgcaaacttcaagatcccgtctcagaacgagtcccggttgwcagaaagcagcgtgtgaatatctcgcttcgctgatcagccccccccyttgcgctccactt

SEQ ID NO: 737 - DNA, 121 bp, Gadus morhua
aatggcagataagggcaacacaccgggaagtcgaggacttagtatatcaaaagcatcctckgtccctcccagcacgtcaggtatcacaaagctaagccccttggtcttacgactgcagtgt

SEQ ID NO: 738 - DNA, 121 bp, Gadus morhua
tatagtgcgctactgaatgtgtacgtagttaacatgaaccacttcacccaacaataaagcrattcaacatgtacttaatccaaagccttgtccataatgtcatgtattttccccatggata

SEQ ID NO: 739 - DNA, 121 bp, Gadus morhua
agaccaacctcatcagcttaaccacatgttcacggtgtttcagccagcatctggatgctgytggggtgcaggtttcatgacagacaggggcagagaaccaatcaggtgttgtttagccccc

SEQ ID NO: 740 - DNA, 121 bp, Gadus morhua
caaaaaccaaaacaacaaatgctgagataactttaggcgtacctttcacatcgacttttgyagattcagaaatcagcatccattaacacacatcagaaaagtgcatgtatctatttattta

SEQ ID NO: 741 - DNA, 121 bp, Gadus morhua
taagactcaaggctcccaggaatggagaaacagccagcccgacagctgatgtaaagccagragttccttagtgctttctccatcgaggccaggtcaactcggggccggtctgtagcctcac

SEQ ID NO: 742 - DNA, 121 bp, Gadus morhua
tggcttcccttctttacaaactgcaagttatggcccgttattaccaaatgccagcacatcrcaaagaagaactgttagcattaaccccggtactgtagtaggtgtggttagagacacagag

SEQ ID NO: 743 - DNA, 121 bp, Gadus morhua
ttcacaagggtggggtggtgtgtgtgtgtgtgtgggggggggggggtataaaagaagggamcttctaataatcactggttcaattgacttaatatcacacattagttttaaccttgcgtaa

SEQ ID NO: 744 - DNA, 121 bp, Gadus morhua
ggctgttgaggaagcttgaaaactcaagcatttcagatacatcttatcaatgctgacatgwcaatgacaatatgatccgaaaactccccgaatctgtgcatgtgtgggaaagagaacaata

SEQ ID NO: 745 - DNA, 121 bp, Gadus morhua
cacataatgacaaccatgaaattgcacaaactaaatgacttggaatctcaacatggcaaarccaaataaaacaaaggtttgttgaacaatggtttactgttaagtctctgcaatgaggcaa

SEQ ID NO: 746 - DNA, 121 bp, Gadus morhua
tttaatgtcgatcagcaggcgcgcttgtaaaggcggttgagctagatggtaatgacgaccrgcatcattctgaactggtcacagaccccataatactgaatctttttaaacgtcagtttaa

SEQ ID NO: 747 - DNA, 121 bp, Gadus morhua
acaatgactttatagaaacattttaacctgtgtgcattagtggtgaccgtgggtcatgggwagatcgggaacaacttcacccgtctccaaaatgacatccccgggaaaacaacttgggttt

SEQ ID NO: 748 - DNA, 121 bp, Gadus morhua
cggggtgattcgggtgacatcgggctaaaaatgtatgatcgggtcaatttatcggggtagyatttacacatacccgatgttataacgataacataacgatgtatgccagggaagacacccg

SEQ ID NO: 749 - DNA, 121 bp, Gadus morhua
aaaaataaacatggcacttttcccttaaattaagttgaagtatttttcttattttgcacakacaatgttaacatttggaaagccttgttgcattcaaaaatgcatccagtggggcatcaca

SEQ ID NO: 750 - DNA, 121 bp, Gadus morhua
aactgccatgcataccttttctaaagaaaaaaaaaaaattaaggtctgtttagcatatgtycaggttaagtgacaaactaaggcagttttagaaaatacgggatacaagtgcaagaggcac

SEQ ID NO: 751 - DNA, 121 bp, Gadus morhua
atccttgtgtcgtctgtcgtcttattttatagggtggcggtgattgatggtccctttgggygatttacttcttccattgcttgtgcctcgtagtcccactgggaagagaagccctccactg

SEQ ID NO: 752 - DNA, 121 bp, Gadus morhua
ttcatttcagtaggtcacatcatttaaaacttcgcccgtcaggatcactagctgattctcwagcaaggtgttggaacaccgccacagcatccgtaacttctgaggataacatttaggtagt

SEQ ID NO: 753 - DNA, 121 bp, Gadus morhua
tctttttttgttagacaccaacatcatcctcctgttgcgagtgagaacatttcgcaaatckatcacacatcaaattgtactgttacgctgtctgttccgtcaaacatcattagaaaaacct

SEQ ID NO: 754 - DNA, 121 bp, Gadus morhua
agctcgacctccatcttcccgaccatagagaccagtgcctccattattaccaactacctgractcaaaccaatagcatttcagctgcagagctgaacacaaataaaaacaacaaacgatcg

SEQ ID NO: 755 - DNA, 121 bp, Gadus morhua
aggatataggcaaagccctgcctaacgtcttccgcaatggtacacacgacatgcctctggyggaatgtttcacctgacaactccagaaacatctttctctataagtagcatcaagttcggc

SEQ ID NO: 756 - DNA, 121 bp, Gadus morhua
cgacacacacactggtgggtgttcagcagaacaaggtagtctcctcattggctgtcggccrggtctctgtcctccgtcagctgagtcttctgcacctcgaagctcctcggcgctgaccatg

SEQ ID NO: 757 - DNA, 121 bp, Gadus morhua
aaaataagctaagagacaaaggctatgagtgagtgattggtcgttgatatgctcatgagcrgggagcgcagtctcctagtggtaccgctccacggacagagcgctctgagctgaaacggtt

SEQ ID NO: 758 - DNA, 121 bp, Gadus morhua
ctctccctgggttaacgctgacctagtggcctataactgggagcctcatccactggtctgkgcagtctgttttaatggtcagcatcagcccgggccaatgtgaccctcatcctccaattaa

SEQ ID NO: 759 - DNA, 121 bp, Gadus morhua
acaattcctttgattttgttgccaagtttgtgataagggatgatttgagctgtgcaatcgycgaaatcttcatcactcttggcagacagcatacttgttcttgacatgccacattctttgt

SEQ ID NO: 760 - DNA, 121 bp, Gadus morhua
agtaaaccacatccaacgtttttccacagagagaggtttttacacactgaaacttttggcytttaaagcaggtaggatttctaaagactgctcctttcaaagccaggtttaagtgggcaat

SEQ ID NO: 761 - DNA, 121 bp, Gadus morhua
atactatgtgtttgccacccagtttgtgtggagctccgtcttagcagcggttaatcagaawgttsgtgtgggtcgtaaccatgggacaccgcgtatcccccggaactctcaaacaaaaagc

SEQ ID NO: 762 - DNA, 121 bp, Gadus morhua
gacagtagtgcatagacgggttctgagatcattcgaggttcctctagaacctcaccggctraaaacagcattatagattggtccacagagtgcagagagagtgcttcagcccctcggagag

SEQ ID NO: 763 - DNA, 121 bp, Gadus morhua
caaagtatgcatcctacatgtacaaattatgttcagtgccatctacaactatctaactatrtggtgtgtctgacggttttgcagaggcatttgcagccacctcaatgcaagagagctgaaa

SEQ ID NO: 764 - DNA, 121 bp, Gadus morhua
caaataaaaaggcgagaaagtaattttaaccatcttttttggattaattttccttttcctyttaccagtggtttataatacggccgtaccacctgccaattttccatcaaaatagagttgt

SEQ ID NO: 765 - DNA, 121 bp, Gadus morhua
gtcgtatatttgatctgtgtaagagggtttcacatgacgtcacggtcacgtacattccaaktgtcatttcagacatttctgacacttggaatgacttttctattcccccattataatagga

SEQ ID NO: 766 - DNA, 121 bp, Gadus morhua
tgctttaataagttaataaatcttctgcattgggaattagttatttacaaacaaaagtacwtatatttaatatcatgcaggctgtcaatccgtcttcttgtctgctactgtagctgtcccg

SEQ ID NO: 767 - DNA, 121 bp, Gadus morhua
cctttactaagcggtaaagaatacagaattgcagattgagtaatcgatggacccactcccrgcaattcatttaattgtgtctgttttattaacactcgtgtttaatctcaattgttcattg

SEQ ID NO: 768 - DNA, 121 bp, Gadus morhua
gaattcagtcgctctcatctttatgttctttttcccttcaacattttttgtggaagagcgragtatggcacgacgaacatgagttttctcatctgtggttttacattgaggggagcattct

SEQ ID NO: 769 - DNA, 121 bp, Gadus morhua
atcaaactgttttctgatttgaattacactagaattgtcattgtcaacaataattatgttwdatctgtttatttacaatataggacacaaagagctaaatgctaaattagataatcattca

SEQ ID NO: 770 - DNA, 121 bp, Gadus morhua
tctttgcacgagtggagggagggagtagacctcgaatatgaagaaagcgctagcttaaacwagttttccgggcaaggcgtgttcaccattccctctccagaccaatagcgctctgggtctt

SEQ ID NO: 771 - DNA, 121 bp, Gadus morhua
caagcgatcctttagatagatataaaatcgtacccagttggggaaattggaaacacacaawaataatctccaacttgtattattcaatcttgttgcaatctgtgcgtcagcattcaaatat

SEQ ID NO: 772 - DNA, 121 bp, Gadus morhua
tttagggatgaatttcagtgagctgctgaatattcagaagcgagactttcccttggaaggmccatcgttcacaaactcatggcccaatccgttcccgcacttcccacagagaaccttgaac

SEQ ID NO: 773 - DNA, 121 bp, Gadus morhua
ttagcattttaccatctttagcacawcttagataccaattctcgacagtcaattctaaagkaaacatacaaaacaaatttgtaaaaataattttcaactgcacacatgtctgacacygggc

SEQ ID NO: 774 - DNA, 121 bp, Gadus morhua
gtggtgtaaggtgtccatggcattcaccgatctctccaaaaggtgaatttaaccatgacgraactatacactttaaatgacaggggcttacactgaaatacttcctgcttattaaaggaaa

SEQ ID NO: 775 - DNA, 121 bp, Gadus morhua
ccatcatctttttccccccactataacaggaactgacagctttccatgtcagttcctattygtgcacatttgagggagcaggaaatggcaaaaaggtcattgccaggcctggtgttttgga

SEQ ID NO: 776 - DNA, 121 bp, Gadus morhua
ggcaagcatctgctagagctctcagctgtttggtataccaaggccacagtggaaacatccmgcaatcaactatcactcctaagtatcaatgaaagtacagtaacttcatgtatatggaata

SEQ ID NO: 777 - DNA, 121 bp, Gadus morhua
tctccgttgtttttggtgattttcttggcatctgacaaacagtttctcttctgacgcttgwaaatgctgcccgtcttctgtcgccgggcagaaagatgtcctcttctgcgtctcccccact

SEQ ID NO: 778 - DNA, 121 bp, Gadus morhua
gaatttcctgtgggtgtggtggtctctacttgccaagttcaagacaatttcaaccccccawacaggacaacaaactagtttgggcattcacttgttaaacctcaagttattgcccccgggt

SEQ ID NO: 779 - DNA, 121 bp, Gadus morhua
tcaaaaacaaaagcaaatgtgtaaaaaaagaaaaaaaagcatcaaaaccaatccaacactwtaggattgaaacatagcaccttgtctctgtcgatatggattcttagactggattatagtg

SEQ ID NO: 780 - DNA, 121 bp, Gadus morhua
aataagagttaatgtgaatgtgatcatttgtcatgcagcatcagttgtataaaatgtcagyaccagtttgaaaacaatgccattcgttaacaaagaaacaaaacaaaaactacagtcaatc

SEQ ID NO: 781 - DNA, 121 bp, Gadus morhua
attttttaattctagccctaattagaaattatatatatcaaatcaccaggtgtgacatcamctaaaacattcaccacaccatgcacggttcatggactgctttaacgattcaggatctcca

SEQ ID NO: 782 - DNA, 121 bp, Gadus morhua
tttccagcaggccacaactcctgtctgtggagttacactcaaggctggctgacttctctckgtatatttcgaagaccagttgaacaaaaaggaacaaacgcacgaactcttaagaagttca

SEQ ID NO: 783 - DNA, 121 bp, Gadus morhua
acaagaaacaatgttactcgacagggttaatcagccacgtttagcaaggtaaactaaaaawdttttactgtgttgtactgtgcttcacttacaccccctcagtcactgtcaacgttaaatt

SEQ ID NO: 784 - DNA, 121 bp, Gadus morhua
caggaagcatacggtggagactcaatctagccttaacaaaggggaatcatcaactctgttkccgtccaataaatccttgacggattggaacattagcgggatttatccaaatcctggacca

SEQ ID NO: 785 - DNA, 121 bp, Gadus morhua
atctggccagaatccatcatttaatcttgctcatcgattcttgcttttaaataaatatgcycaggagaaacaaacatacaaaaatatggtatatcgtttaaagtcaattctgtaaagaaag

SEQ ID NO: 786 - DNA, 121 bp, Gadus morhua
atcagagaatcagaaactctgactcatatacttaaaattaagttattaaccctaacccaascctctcacacacacacacacacacacacacacacacacctgactggccactaacatgaag

SEQ ID NO: 787 - DNA, 121 bp, Gadus morhua
atacattggcagtaattattttttgggatcaaaatatcacgactgattaaaattctgaatratatttgaaggggcccaaaacatgtaaattaatttattttaatagatatataaaatattt

SEQ ID NO: 788 - DNA, 121 bp, Gadus morhua
cggtacatatactttcttggcccaccagccaggatctcactcggttttccttacacacacrcgctcactcacaccttgagagaagttgtccattcatgtgcacataagccgccctgtagtg

SEQ ID NO: 789 - DNA, 121 bp, Gadus morhua
tctactcatcctaaatcagattagtgaatatagatacagcgtcattaaggagattgtctaraacactagacaatccttcatttcaacatggcgagtcccatttcaaatcatttctaatctg

SEQ ID NO: 790 - DNA, 121 bp, Gadus morhua
taaattgttccttcagttggaaggactattcacgtatactttcactgaggatgtatcaaakactctcagtgtgcagccagacaaatgtgaacattacttcaaactaaaagatatctagagg

SEQ ID NO: 791 - DNA, 121 bp, Gadus morhua
atatgtatagtgttttgttttggtacaaactgattatgaatctcgctagagaatgtaaaakaaaccaaacaattcagacacgttttaatgtgcaggcacagcactttcaaataaagccaaa

SEQ ID NO: 792 - DNA, 121 bp, Gadus morhua
aactcaaaatctttgacgtagtaaaattgytgctttagaaaaatacttcagctatccaaawtttgaggacgcacatgggaaacctattgctttttgttaatcttttttataatgtgtattt

SEQ ID NO: 793 - DNA, 121 bp, Gadus morhua
atgatatgaatttagaaacttggcgtaaaacacaaaagcaaatctgtaacatgcagtcccrattcatacgttttcaaataaacggataaacgtcttcaacacgcgcacggtatactaaaca

SEQ ID NO: 794 - DNA, 121 bp, Gadus morhua
acttcatttcgtctctcttttcttggcactagagttgacctttgaagaagagcacggaagrgagacaggacagggtcactgtgattggttgacgtgcaccatggcaacaagatttcagttt

SEQ ID NO: 795 - DNA, 121 bp, Gadus morhua
gaggggaaaaaccactacgcgtccccataatactgagacggcattcacgttgtgggtcttrttgraacatacaggtcattatttaacaatacaacaatgaacayraatctttgttawcata

SEQ ID NO: 796 - DNA, 121 bp, Gadus morhua
ttawcatacaatcacatggccaaacagcacacaaacaaaactatcmatagaaatcctgagstaatactttttggtcatgtgctacaaggtcataaaatattacaacaggtgcaaaagtaac

SEQ ID NO: 797 - DNA, 121 bp, Gadus morhua
cccaataataggaaaagttcaacaaatatcccaacggcacacggtcgttgtgcatgagacyttacgtgtggctgtgatgggctgacaggtgatgatggtgatgccgacataagagggtaat

SEQ ID NO: 798 - DNA, 121 bp, Gadus morhua
gcctaatggaattgtttcgtacaaagccaaacagtccacatgtagtagcattcgagaatcytgccccagtaatcgtgaagccttttgtatgtaataatagtttgcttttgaacgctataag

SEQ ID NO: 799 - DNA, 121 bp, Gadus morhua
acagtatgacattattttttctggaattttcactttcttctaaattgtatttattcactgyaatgtcgttgttaagtaactaaaatctcaaaaggaaccgcagtcttgtacatgtttaacg

SEQ ID NO: 800 - DNA, 121 bp, Gadus morhua
catagttggcctgggggatcaccctcatgttcttgaaggtactgtgcttgaccacttcagwcagctgtgcatctgtcaggtttttgcccaggaacgaggagatcctctttaccgatgatcg

SEQ ID NO: 801 - DNA, 121 bp, Gadus morhua
ttctctctctaagggcaccccggtggtgcaacgacccccaggcaaacattttattgcatawatcacacgaccacatcttgtcgtatgcccgtgagtcttttttttgggagcaggaataata

SEQ ID NO: 802 - DNA, 121 bp, Gadus morhua
aaaagaaaagtcttcataaatagtaccctatcaatggaggttaaaggtaatttattcctcktatgacgcaatcattcccatgtacctcggtaagactggaaaccatttactggtgggagga

SEQ ID NO: 803 - DNA, 121 bp, Gadus morhua
gagcatttggtgagaatgctaccaacgatgatggcttctcgaaggggtacatgttccagawtcacaaagaggaagcaggatacctttaaaaccatgcccctggcttgaaaagggccttctt

SEQ ID NO: 804 - DNA, 121 bp, Gadus morhua
agtatagtcttgccccagcatagtcttttttctcaagacttggtacaacactgctgcaagwtataaagcttcttcctccaaactcgcattttagaatatggatgcaatgatctgaaaaagg

SEQ ID NO: 805 - DNA, 121 bp, Gadus morhua
catcgaacctcctcctacgccgcggtgtaaccctaaccccacatgataatactgctggtgytggagaggccttttagttgggctattctgagcggagatccggaayacactgcggtgtaat

SEQ ID NO: 806 - DNA, 121 bp, Gadus morhua
agattgctgaatcttttgggagcggatacaccacatgagataaataaaatacaacaatagyaaccctcaactctaatctccacactgaaagaaaacgaatcacgctcaataactagcatat

SEQ ID NO: 807 - DNA, 121 bp, Gadus morhua
tcggttaaactcactaaagatccaagatatctgagtgaatatacagctcgtacaaaagtcwaggactccgcaacaaaaacattggacggttcttttaaaatgcgagctataggaagataaa

SEQ ID NO: 808 - DNA, 121 bp, Gadus morhua
tttaagtttttcttatgaaaatagtgcgcagggatatacaatgcttgctgtacatttggtktgaagtcaatccaaagaactaagcagttgatcctggggaatgaaaataatactaggcatg

SEQ ID NO: 809 - DNA, 121 bp, Gadus morhua
acattttcaactgcaaaaacactttctactataaataagagattgtgctgcccgggaatcktaggttgatcaggattagtgcatggcgtggtcttctccacaggtgtagctcatcaggtta

SEQ ID NO: 810 - DNA, 121 bp, Gadus morhua
agacaaatcgggagagctcatgccttacaaatcagttgtttagcaaaacagaaatataccraacaacttgacctagcaagttttcacttgtttggatacaatagcacggctaggatgtaca

SEQ ID NO: 811 - DNA, 121 bp, Gadus morhua
tcattacatttctaccacctatctaccaagataacaagagagaagagagtatcacaacgckcaccgacagatgaacagtgaaaatgtggatgggagctggtaaactgtcaccgccctgtgg

SEQ ID NO: 812 - DNA, 121 bp, Gadus morhua
ggtatagattttccctcaagtaaggccatttgaatcatcgaaagcacggaatacagaaacrgttaaataaattgaaaagccaacaaaacgtccaatgtcaaataatacaaaaaaagaagat

SEQ ID NO: 813 - DNA, 121 bp, Gadus morhua
atcgtacataaagcgtttcaaatcaaatcaggtacttctgacaccaccttagcctatcacwgggaaaacaaatgaaaataaaactagtgtgaatgccgtttgtagttgttcttttttggag

SEQ ID NO: 814 - DNA, 121 bp, Gadus morhua
ttgtgtactactttgatgtgcgctaggtagtgctgatgtctgattctcacacaggcttatragaatgtaactccaaaggaaatagcatgtgagcacattatgtgcacaagccaagttgcct

SEQ ID NO: 815 - DNA, 121 bp, Gadus morhua
atagttcaatcaagaagaaacaatttagtacgacgccattaaagacaagtggttatgttgwggaattaacaagaacatcgttgcagaccagcaaaagcgcctaaagaaaaattgtctatac

SEQ ID NO: 816 - DNA, 121 bp, Gadus morhua
tggaaagccccccatcaaatgcatgagactttgtaaggtgttccaatacactggtaagcartgtacatagtagcaccgactacacctgtgcttgtaagacatgcgtgtgtctgcatgaagc

SEQ ID NO: 817 - DNA, 121 bp, Gadus morhua
atggtgcctttagcatctcaacaaataaatgagtctgatattgaagagaattcattgaatwatgctttggataaaaaaacatgttggtgggtattttaagatattgacgttttcatatagc

SEQ ID NO: 818 - DNA, 121 bp, Gadus morhua
atgcaaaaccaaccatatatatgttattgtgatatgtatgtgtcacagtggaaaggacgtkgtgaacatctctgacataatttctgaataatacaaaaaagcaaaacgctgcagttgtgct

SEQ ID NO: 819 - DNA, 121 bp, Gadus morhua
ctctcacgttactccagcgcaagatcctcttcttcagtctcaacgacggttagataacgcrcgaatccttgacagatagaacactgaaggaatagaaaatgagaattttacatgtttttta

SEQ ID NO: 820 - DNA, 121 bp, Gadus morhua
gtattgagtcctagaagtatcgagtcctagaagtatcgagtcctagaagtatcgagtcctrgaagtagggcatagccggctttcagggaagtggtcttcctacctgtaggattttgaggtc

SEQ ID NO: 821 - DNA, 121 bp, Gadus morhua
cggagacacccttccctcgaaaccttctacatgttccctcccccttctcgcctgcgctgcyaaagaggacttcttcataatttggaatgaggtcctcggtttaaaaagcgtgcgggataaa

SEQ ID NO: 822 - DNA, 121 bp, Gadus morhua
cagggtcacgatataaacagttaaactagtcaagactcattttagaaattacacatgatgytcggccaatagcagctctactcttcagtgtccctgtgctttagtcgtttagaaaagacta

SEQ ID NO: 823 - DNA, 121 bp, Gadus morhua
tctagtttgatattttacatttgctatatcaaggcttcccactttgaacacaggtgtttgycccatcatcactgttatatagccacagtctacatgctggtagtggtgtcacaacttggag

SEQ ID NO: 824 - DNA, 121 bp, Gadus morhua
gctttatttcagttctttttctttcggtataggctcttcagtagataaatcacgcagccarcatgttggtgcgtgtgtttcgtacaaggcagtacataaaaggcgcacaaataactttttc

SEQ ID NO: 825 - DNA, 121 bp, Gadus morhua
gaggcgcttaaatcaattaaaagatagaacgcatttgtgtgaatcatccttgcacgcagcwctgctgtaaaatccctattttctaatgacctctactggtcatccacagaacagcgtttcg

SEQ ID NO: 826 - DNA, 121 bp, Gadus morhua
agaccatgcaaattaactacagcaatattacagcaaatgtgtctttgctgtagtctgaccwaaccccctggaaatccaaaaggttaaacaatcgcctatttacctttaatcttcaagatag

SEQ ID NO: 827 - DNA, 121 bp, Gadus morhua
ccaaagcaaaaaggaggatactgtcctactacattaggaacgccaagtgaatgaaacactmaaaactcaacattagtaagcaactgtagagtttaaattatagggtgccataattatgtaa

SEQ ID NO: 828 - DNA, 121 bp, Gadus morhua
gagacggtcaactcaaatattcacgcaaactcgcttcaaagtcactttattctcgggttamctgcttgttcacaaagcacccaatgaaatgtctgtgtccaagaccaacaaccagatccgc

SEQ ID NO: 829 - DNA, 121 bp, Gadus morhua
atgtaaaagatgatcattagtaataatcatctaaaaaataatcgtacacacaccagctttrcatacaatttctatgcatgcatcaggtttgcatttggacacatgtgaaagatcmccaata

SEQ ID NO: 830 - DNA, 121 bp, Gadus morhua
caagtgcacatgacaaacatcattggcggaagatatatgctttgttgtttggtgtgtgtgyttttttaataagaaagcttcttgaggcctatgtaacagtataagtacagggtggtcatac

SEQ ID NO: 831 - DNA, 121 bp, Gadus morhua
cctaatggtaagacaatatgattagggtgacaaatctgcaaataaagaattatcactgacrtccatatgccttccttttcttcaaaagaaaaagaagacatttccatttattatatttata

SEQ ID NO: 832 - DNA, 121 bp, Gadus morhua
cacgatatgcttaagaattcaaaaaaggtatatggctatgtaaagtatggcatcagtgtaraactagttttcttttctccatgtcgttttcccttgtctccgacacttcaaacctcatagt

SEQ ID NO: 833 - DNA, 121 bp, Gadus morhua
actaacacatttaaatctctattaaggcaacaataggatagaaccatagatgcaaaccctrgggttatcttttggaggtttaaaagttgctattgcagttgaaggccacaaaaacgtacca

SEQ ID NO: 834 - DNA, 121 bp, Gadus morhua
acctctgcatcgtcatcctcactctcgtcgccagcatggtcatttgcttcatcattattgscatcgtcatcatcaccctgcatccttagtgccgagctggtctggcatccacagcagttat

SEQ ID NO: 835 - DNA, 121 bp, Gadus morhua
ccaaagactcccacctgacggggaccaacccggctccatgtcttccctccagagcatgggrgatctctattggccagtaacaggacatgtaatcaactatgaacatgagtagttgaaaaag

SEQ ID NO: 836 - DNA, 121 bp, Gadus morhua
accatgttgtcttcatctttatctttaattccatgacttcatcatcgctataactttaatrccatgttgtcttcaccatcgctataactttaaaatcatactttgaaagagtttaatcaga

SEQ ID NO: 837 - DNA, 121 bp, Gadus morhua
atgtggttatttacagacaggagttttatgacagaaaggtattaaatgagatctgtgtgckcgcattccctgggtttacaatgtctttgaaaataatgagaatttctaaaacctgaaaagt

SEQ ID NO: 838 - DNA, 121 bp, Gadus morhua
tgttaaggcttgaaatctaaatcttttgaggctatttatgtccaacatgaaaggcaaagcrctgcattttggagaataatgacacaagtagtcagaatgtaaaccacctatattccaaatt

SEQ ID NO: 839 - DNA, 121 bp, Gadus morhua
gagtgaagcaagtgtgttaaacgttgaatgttcaattggaatttgtgaaaatgattcagcrcataagggtttaaatcgaacaaaactagatgaattgaacttggtcgtcgctacagaataa

SEQ ID NO: 840 - DNA, 121 bp, Gadus morhua
agtttattaaataaccatttgtttaaatagtctgtgtcctaatcattttgtacccaattgrcatcaaggctcaggtgagacaaatgtttaggttcagagctacagactgacaaggaaataa

SEQ ID NO: 841 - DNA, 121 bp, Gadus morhua
tgtcccttaaaatatccagctacacgacaaaaacagtgtgctatcgaaagtcactattgtytctcttgttgtgaggccacgcaaacgagaggattggcaatttagaaacttgagatggtga

SEQ ID NO: 842 - DNA, 121 bp, Gadus morhua
tcaatttacatctgatatgtctaatatcaaagttcagcccagatgattggtcgtaatccarccaatccagtcattttaaagcattctataaagtgtactatcagagagatgtgttaatggt

SEQ ID NO: 843 - DNA, 121 bp, Gadus morhua
ctaccaactacactaaagtctgtctaccaaagccgtcttatagcaggaggaggaagccaasaagcttagagagggtaaggggagggcgagacggaaccatggcgacagttgccatgacaac

SEQ ID NO: 844 - DNA, 121 bp, Gadus morhua
atgactttaagtatgacttcctgaaaatcttaaagagcaacaatattttacaagaatccwwattttattggagcctttacataatgtgagaatagtaaacaagtgcttttcttccatcaat

SEQ ID NO: 845 - DNA, 121 bp, Gadus morhua
gacattgctttgcatcaagaaagccatcctaagcaaacatcaatgagacatagagaatcaygatagaaaacaatgggatcgggaaaccccaaaagaaaagcatagaagacaccacagggaa

SEQ ID NO: 846 - DNA, 121 bp, Gadus morhua
gagtaacaataaggacttggtcaccaggtatttgtagtttcatgggttcaacattcagccwcaagagggtcttgtgattacataaaatgttgtgctgaactccgaaagtggagcaaactaa

SEQ ID NO: 847 - DNA, 121 bp, Gadus morhua
gtgattctgatcaaggcctcgaccctttgaaacatgaccgatgagatgacacaactgaacrgatcaaaccatttaggcaacacatgaaggaatgctccgaagacttgattgatccacagta

SEQ ID NO: 848 - DNA, 121 bp, Gadus morhua
ggagatggatgacaacagtggtgagagaggggttgaagtaattcctgtcaatgcactgtgycggagtgactccaggatattggagctcttaaatgtaacagtacatctgaacggttgttcc

SEQ ID NO: 849 - DNA, 121 bp, Gadus morhua
aaaaaagtgaggaccaaacctacgcatacattcagaaagagagagaaaacattgcacggargtcaagagaatcaatcaaaagtggtttggatggatgcatatgatgccaccgatcacattg

SEQ ID NO: 850 - DNA, 121 bp, Gadus morhua
gaatctctacagtgtggctgccttaactgctggtgctaaattctctcagcgaggaagaacygctgtgattaaacggtctcagataattatacattacagctggcttatgtctgtctcaggt

SEQ ID NO: 851 - DNA, 121 bp, Gadus morhua
ttgacatttcacaaagccaggttctgacagcagaattcctctttggccttcaaatgagtcrtacccaaattgtcttgttaaaaaaccttactaaaatatttgaatatctttgaccattagt

SEQ ID NO: 852 - DNA, 121 bp, Gadus morhua
tccaaaaagtacagaaaaatctccctcagcagaagattttccttgccacaaaagtttgacracaatttacatcgacattaacaaacacaaaatgttaaaaagacgacaaccaaaagaaaaa

SEQ ID NO: 853 - DNA, 121 bp, Gadus morhua
ccgctgaagtcctgattcgtgaaccacagccgtacgtaacgtacgtaacatacgtaacgcrccacaacgctttcaaacatcggaaacgcccgctggctctagcctacctgaaacactacat

SEQ ID NO: 854 - DNA, 121 bp, Gadus morhua
cacattgccactcattgatacccatactctactccccatcccatcttcaacatcccctcamtctcccctagagcagtacccagtccattgcagatgggagagtgagggaaggtgggggtgc

SEQ ID NO: 855 - DNA, 121 bp, Gadus morhua
tgcctgtgtgtgtaaagtcaacaaacgttgtgaacatatggacgtgatgcagttctgggcrataatactgaatgaacgtttggatgaatgtgcttgtgtatgcatgtcttcatggctatta

SEQ ID NO: 856 - DNA, 121 bp, Gadus morhua
acacttgctttcttatctggacatctaagcattggcaatcaatttgttcatagagaaattyaagggatgccgatgcataaatgcagcacttgtctctttctacaaagccccttaaatgtta

SEQ ID NO: 857 - DNA, 121 bp, Gadus morhua
aaatgttaataaaacattcacaagcatagtctattaagtttggtagggactgaaaaattamttttgctaacgctacagacactagtgatttccatctactgcaatacaacattttgaaagc

SEQ ID NO: 858 - DNA, 121 bp, Gadus morhua
atcgtaaagtgaaggcaacaagaacacagattatgtgcaacaagcaccattcacaaaaacmactatgggtgtgttgtcagaacgccagtattgatatttctggaagttaactttacattgc

SEQ ID NO: 859 - DNA, 121 bp, Gadus morhua
acaacagagaaacacattggggggcactgaaggaacacaggatatgttatattcgaagacmgcaaatagtggggtaaggaaaggacacacactgaggaaaaacaacttcacccaagttata

SEQ ID NO: 860 - DNA, 121 bp, Gadus morhua
tattccaccatttcatagatgaccaaagtgatgttaagaatgaaacattgtttgatgtgtycgagaaagttcaggtcacgcaaagcagtctccctgaaaaaacaaagcattgttaagaatg

SEQ ID NO: 861 - DNA, 121 bp, Gadus morhua
ccccttcatcttctccttcacaaggaagaaggacacgccgtacgttttgagagacctagcragcttgacgtagctgactttagcctcgatttctgtcatattctgggagttttggtgtgcc

SEQ ID NO: 862 - DNA, 121 bp, Gadus morhua
acttgagtggccatttgccactcacgtacgtttcttttttgccatcaggtcaaagtccatrtgtgtgcagcatacagaaattgtgactcatgcgctcttcgcgttattgcagcaacagacg

SEQ ID NO: 863 - DNA, 121 bp, Gadus morhua
atcagaattttaagtaaatctacacaacaatgttctgactttaagcctctacgggcagaaygtgtgtaggaatgttcagaagattaatacttaacaatccccatctttatggagaaataca

SEQ ID NO: 864 - DNA, 121 bp, Gadus morhua
ttctctttttttgtagggtcaaagaaaacatcctcttgtattttcacatcaatccaagtgyagtttttctaaattgtgcgtggtatctgatttcagtccaatgckgttttttttaatatca

SEQ ID NO: 865 - DNA, 121 bp, Gadus morhua
tgttactcatccaaccttttactttaatcggccccgtctaaagctttacattaagtgtttygatttcacaatcattccttctctttcactctttcatttgcatcacagaaaaaaggcatag

SEQ ID NO: 866 - DNA, 121 bp, Gadus morhua
acaaatacacacacaaagagttcagaactcgatgggggggttttccttacaaagagcaaargctgattttgaagttggccttccgttaccagtcggtgtgaggtgagtcggatgcatggac

SEQ ID NO: 867 - DNA, 121 bp, Gadus morhua
cataattgtggtaactatcgttaccgtaaaggtttggaaaatcattttctacacgcttcgyttcctttctttaaagcaaaaggcctcctcaacatcgggtttgttcacatctcatattttg

SEQ ID NO: 868 - DNA, 121 bp, Gadus morhua
gagatcttcggctttgacccccttcttctgagatatctgctggtttgttttctgcattttyttctttccctgtttctccccacctttgccccccatcgtgttagagacgctctgaggccca

SEQ ID NO: 869 - DNA, 121 bp, Gadus morhua
tctaaatcgactaaggttaccacccagagccagacttcaaggataaggctagccaaattcrgcttttttttcaattttaatgaaaccccctttataaaataaaactgcataggcagtcgat

SEQ ID NO: 870 - DNA, 121 bp, Gadus morhua
tttgatgtggttcacttcatttccatctttctgtggcgattggccctcattgctcctttgygattggatattatccagggtagttgcttggtcttcatgcaaatccttactgggagtctct

SEQ ID NO: 871 - DNA, 121 bp, Gadus morhua
cccctaagctttcactgaaatcaattacaatagttctgggggaatgcaaagtcatgctaamaacagaggtcaccatttaacctgcccgtgtcttcaactgagtacatggggtgacaagcta

SEQ ID NO: 872 - DNA, 121 bp, Gadus morhua
gcaccatcgtttacactgtccgacatggcatcaatttacacggtcataatgttgataatcwaattkcttatgcaatgtaagctaatacaaatatttgatggccaaattgtgataccctact

SEQ ID NO: 873 - DNA, 121 bp, Gadus morhua
ccccccagaattaccccctttgctacactgcaaaaatattgctgatcttggccaattgtayacaccctttacaatgctatacatctgagaggaaatccaatccagggtaaagcataattaa

SEQ ID NO: 874 - DNA, 121 bp, Gadus morhua
ttatgttttcttttttaattcattttttttacacacgtgtggtagcactattgtggtttcrgaatcgagtgtaggctcagacgttgtgaaggaaaatggttgttttttattgttgcccatc

SEQ ID NO: 875 - DNA, 121 bp, Gadus morhua
ttcttgttagaagtacacattttggcaaataaagttcagaaaaatacttaatagggaaaawaggacctagcgtcggtattccaattattgtgaatagattagtgacaaaagtcaacagcaa

SEQ ID NO: 876 - DNA, 121 bp, Gadus morhua
gaaggtcaaaaattgtctgcagtattaaccaagacatagaaagtttgatatgaggttgtamagttcaaactaccatattaggtcatgttcatagcatgaccagatatgggggttatgattg

SEQ ID NO: 877 - DNA, 121 bp, Gadus morhua
atgttttggcctttttttcttcttttaaagacaagttcaccactggatgtccttggtgcayttccctttgccatatgcaacatggacaaactatgtaggtcttccctggtaccgaacgtcc

SEQ ID NO: 878 - DNA, 121 bp, Gadus morhua
gttcaaacgcgaaaattataaatggtccaacactgttgtcatagcaacacagtaacacggygtccctcggcaacccctcagcctcgcgagggctgcgctttgcgcccctggaagactcggc

SEQ ID NO: 879 - DNA, 121 bp, Gadus morhua
gtccctatactccagaaaacacttcccactaaaaaccttgatcttcatacaggcagagacrtacaagtaaccaaacaaaaataaacatttcaatagatctccaggtccaaatcagcttgat

SEQ ID NO: 880 - DNA, 121 bp, Gadus morhua
gacaggcacctggctgcaracctaccgcctgagtgatcatgcagccagacactcttgcaaraaggagcaactcttattatacatcatacattgaaaactaaacttcatttccagactcgga

SEQ ID NO: 881 - DNA, 121 bp, Gadus morhua
taataggaagaaagcagatgaactgagccacggttttccaagcttgatttccagcaggaasttggggcggcaagacacacaaacacacacgtatacgaagccactatctcacatgttaact

SEQ ID NO: 882 - DNA, 121 bp, Gadus morhua
ctctgctaaatgcaaagtgtacaaaagtaaaagcttaggtggaacgggaaaaaaatgacgrcagctcaatttacaaacaaaaacacattcaacaaaacgggacaaatgttggagacccagt

SEQ ID NO: 883 - DNA, 121 bp, Gadus morhua
aaatacagcacttttctgtacaaaaataattgttatctcctgtgaagtttccatgttagcrgaggactaaatgcagcctcatgtttaaagtacagagcattggtggcgttttgtatttctc

SEQ ID NO: 884 - DNA, 121 bp, Gadus morhua
acggtcacaatctattcacagcaaggagcatctctttaatggtcaggcagtataatcattktaacatcactggggtgtgaccggcacaaattaaatgacctccgaccaaacaggcgacatg

SEQ ID NO: 885 - DNA, 121 bp, Gadus morhua
attaaaatgagaagaattatgggacacaaattatcaagtgatatttagcactagaacaaakaatttgcgattaactcgcgattaattagagttaactatgacattaatgcagattaatcac

SEQ ID NO: 886 - DNA, 121 bp, Gadus morhua
ttaatttatttacagaaaaagtttcaaaagtatacaacaaaaaagtcaaggcatcatgacraaatgtccattatttaccatttatgaacattgtatttacaaacccttgatcaacacagtc

SEQ ID NO: 887 - DNA, 121 bp, Gadus morhua
aggatatttaaacagcagaacaacttaccatttatatatcaatccatgacaaatgattacmaaaatgcatatatacataacattcaatgtgatttcatcatattcatgaacgagataacta

SEQ ID NO: 888 - DNA, 121 bp, Gadus morhua
actaaataaaatacatacattttaatatgaatacaatctttaccaaccacttggcactttwtatttagcaactgtaattacagaatgggaaaacacaattttgagatgaagctacttgtat

SEQ ID NO: 889 - DNA, 121 bp, Gadus morhua
gtatataggcaacaatttctacaaacagagaaaaaaaatccactgtgcaaacattaatgamcaaataacgattgcacatatgttacaaaatggaatacgttgtggaacatctgaacccaat

SEQ ID NO: 890 - DNA, 121 bp, Gadus morhua
ttcggctcaacttttatttatatttgccacaaccaggcaaaccaagaggtgttttctgttygacaaattctaccaaaaaaaaggccatatcaactataaaataaatcaacaataccgttaa

SEQ ID NO: 891 - DNA, 121 bp, Gadus morhua
cccacataactcagtgcatagatctgacggttagtgcaattaaagcacaagaataataagktaaaatgtgtagtctagaagagaatgctaactgtgtttccaaacctacaatttatggaac

SEQ ID NO: 892 - DNA, 121 bp, Gadus morhua
gtagtaaccgggggtgagtgattcaaacgtcagctcagctttgtcaccttactgatgcacrgtgaatccacctgatgagaagtcattataaactgaagcgtcacaatctgtcttgctgcga

SEQ ID NO: 893 - DNA, 121 bp, Gadus morhua
tagctagaaaacgttaaaatgtgtggttatgttatcctcccattgatatacacccattacyctcccccttctccagcctaccactccaagtggtaggctgcattagcagtttaatcttaaa

SEQ ID NO: 894 - DNA, 121 bp, Gadus morhua
tcgctcctcaacctcatctgccgattggctttcatcttggtcatcttcagagcagtccttrcttttcttccttttctttgtggacgtctcgtctccattctcttctccattttgcttcttc

SEQ ID NO: 895 - DNA, 121 bp, Gadus morhua
gtgtgataaaatggtcaaccatgtcagtggagggactgcatttcacagcatacatcctgawtctcaacccttgggagtggatcctttctgctctatccagagttaacccacttggcgtggg

SEQ ID NO: 896 - DNA, 121 bp, Gadus morhua
cgtggagctgtggagcataacaacataagtgttgaaggtaaagcctgaccatatgctcatmaagggtaaattcaacagaggacgatcttaccttgtcaaagttctgcatctggtctcggtt

SEQ ID NO: 897 - DNA, 121 bp, Gadus morhua
aaagcactaatatatacacacgactgctatcattcgatcgactgatcaatagaaacaaacrgatccagcatggcatctctgcggctctggttaacagaagcctatatcaattgattgatga

SEQ ID NO: 898 - DNA, 121 bp, Gadus morhua
tcagcctcgactaaaatatattaaattcaaccaataaaacctacgaattcagaacaaggcratcatatgattagtaaagtaaggtaaggcatggtttgttcacaaatatgagcagatatgt

SEQ ID NO: 899 - DNA, 121 bp, Gadus morhua
ggctcgaccgcttttaatgctcctttgtttgttacagtgcagcttatgacttcccgtctcytatctcttctgacatacgatgagatgatcagcttgtttttttttaatcgctacccaccca

SEQ ID NO: 900 - DNA, 121 bp, Gadus morhua
gattgagaagtggaatagagagagagagtttaaggcagtagggagaacggggtgaagtccyttctttatgtgattccgtatttgaatcggtggctgtcaaatacagaagaggctgtttgaa

SEQ ID NO: 901 - DNA, 121 bp, Gadus morhua
tcagttttaaatggtgattcttattctcaattatttgtcggtcataatcccagagctgcawccatttgcattcccattaataccttgacatttactacaatgcagtgggagttcgacaaag

SEQ ID NO: 902 - DNA, 121 bp, Gadus morhua
accttagtctaccagtgccatgtttttggactggatcttcgctagatgatctgatattccmgcctcgactttgtcacactgggccaggaaatcctaaaaagtaaataaaagcatggttact

SEQ ID NO: 903 - DNA, 121 bp, Gadus morhua
gccgatacaagcctccactcagacaccccccagccagacaacatgagcagaagtaccagcraatggtgcttcaagcacgagtgcagtggatgaagctgtgctgcttgaggacactaccagc

SEQ ID NO: 904 - DNA, 121 bp, Gadus morhua
tttgggcttcagtccccccagtgggaggttggaccaagttgtgagcaaacagttatacgtraacatggaagctgtgcctctctggctcctaggattgaatggcagatgttattttcaacac

SEQ ID NO: 905 - DNA, 121 bp, Gadus morhua
ctagagtaaatcaaaaggataggccgagatatcagtaaattgctgtttgattcaaaatcawgcccaataaatcacagcgccaaaggacagtgacaacgtaatcagtgtctttgtagaataa

SEQ ID NO: 906 - DNA, 121 bp, Gadus morhua
tatatggattgactgatattataagcaatattgaaaaaaccaaatgaaaagtaaaggcttratcattaacatggagagcgcaatttccattgtaaggttgtgtttaagactgactaggctc

SEQ ID NO: 907 - DNA, 121 bp, Gadus morhua
ctatttttatcagatcaatttgacttcaccatacatcaaaaacaaacgcacaaacaaaaakaataccactgtgacaaacatgcatctgacgctccacaaaccaaaaccatcctgcccgtct

SEQ ID NO: 908 - DNA, 121 bp, Gadus morhua
ctacaacagggttttcaaaggatgccraagtgaactgatggcagcttttttccggttaaayctgtacatggttctacttttttgttttttttatttaacataagcctaacagacacaagta

SEQ ID NO: 909 - DNA, 121 bp, Gadus morhua
agtgcagatacatgtagtgctgttcccacctttctcaagggacacagagtaccgcagtggytgggaggaaatcacaycacttcctttcaatagtcaataaaatccaacggtcatgacctct

SEQ ID NO: 910 - DNA, 121 bp, Gadus morhua
tatgctgaagaggttaccaaatgaataaccttactctgtaagggtagaatcgcaaggattwatattgatgtccactggatgtcagaagtcctacatttatttaaaggagtaagaaagatca

SEQ ID NO: 911 - DNA, 121 bp, Gadus morhua
tattctctctaccacccaggcaggactctttgtttgcagtaaaattgatcgttgaaacatmttgatcggtaaaatctttttttaactgataaaccgctttctttactatggcacatcttag

SEQ ID NO: 912 - DNA, 121 bp, Gadus morhua
cattctatataagccagttatgacaaataagtaattttccattattcagcaatttctcttrcaatggctacaacccaaaatagaggataagattaacagcagtcccgtttcaaatctcaca

SEQ ID NO: 913 - DNA, 121 bp, Gadus morhua
cataacaatccattcgctgttcatgaagatttggcccctatttaaatgggtgagctgacawttgacatctttattagtcaggaggaccatttggttaatttgcaggcttttaactggtgct

SEQ ID NO: 914 - DNA, 121 bp, Gadus morhua
ataaagacaaaaacaaaacaaaccaaacatgttgcgtcaaccatcttttttcccagtgagygttttaatattgaaatgccatcaggcgaagcgtaaccactttctcttcagtcaagctggt

SEQ ID NO: 915 - DNA, 121 bp, Gadus morhua
actaaatcgacactgaaatgttaacacttttaataagaccctaaagcaaaggttgaagtgsagtgcccaaagaaatgtattattacaatatctgaccatactcttaactgaaacctatgaa

SEQ ID NO: 916 - DNA, 121 bp, Gadus morhua
gaaaatcggatagtatttttaattgtttatttataaatatgaccaaattaagtacagggakaccaatggccaatgtaaaaggatgccacatttcatccgggagacaaatcatgttcaatga

SEQ ID NO: 917 - DNA, 121 bp, Gadus morhua
agcagccacaccggtaagattcacagcagatttagcaaaagcgaagcatgatggctaaccrgaggagcaagttacccttgaagaatatattttcaatatggcagctgcacgtagaccggac

SEQ ID NO: 918 - DNA, 121 bp, Gadus morhua
aatacttggacaaagcaacgtgactgtgacacatatcagacccgtggaaaccaaacagttrgacagtccatggacgatataatactaaggaaaaacagggtaagaaagcaggctacaagaa

SEQ ID NO: 919 - DNA, 121 bp, Gadus morhua
cagctacagtgctcattgtgatgccaactgccgtgccaggaagttgctatttttattgaamcataaaacactgcctgggtttgcacagaagtgcatgccgggtgtgtaggccttcatgtag

SEQ ID NO: 920 - DNA, 121 bp, Gadus morhua
aatagaatccaatgtatacggcatcctgtgttgagccccaaagcgccctgttgaagctcgrgtgatgagcattcgttaaactatcacaaagaatttctcactgtccaagtcttgcaaaata

SEQ ID NO: 921 - DNA, 121 bp, Gadus morhua
acagttccagctctaaaaactaaaacatcttcgatgacataacagtttttacacaatgccrcacagccaatactgaattagagaattgcaactagggaggctttcttctattaaggacacg

SEQ ID NO: 922 - DNA, 121 bp, Gadus morhua
atgaggtcgccctcctccagtgtgatgatctcggcttatgtaactgatgagaaaaggaatkgagaaaatcatctcagccgtgcagccgttctgtcgcaaactggtcattcaccttyaacca

SEQ ID NO: 923 - DNA, 121 bp, Gadus morhua
tatgtacccacagattaacttgtactaataacgtgcttctgaggttataaagaagcatacytttctacttcgccacttcatcaggaatcgctccccaagtgttcttcctagagatacttat

SEQ ID NO: 924 - DNA, 121 bp, Gadus morhua
gtcaaggcagggtggggtcgacgcgaatgatccacagttttaaaccgaataacaaaatggscacaccctagcaacatcccgcgctgttgccatggaggacacccttaaacttcccgcagtg

SEQ ID NO: 925 - DNA, 121 bp, Gadus morhua
ggaacacggtaaccacaagtcctttatgtacaaccgtacaatacatctcagcgcctcagasaggagacggtatattcacaatgacacatggagtatgggtaagtgtgtgctcccgggtgta

SEQ ID NO: 926 - DNA, 121 bp, Gadus morhua
ctgctcctaagcggatataacgcaggcgagttcaactttgataacactctgaatatcaagyagttggtaagcgaggcttccgtcatggctcacgaactggaagtcataaggtccgaatagt

SEQ ID NO: 927 - DNA, 121 bp, Gadus morhua
acctcctggcccttgaggctccttatactatatggtgctaagaataactggcgtcaatgtraagattgttaaaaccaaaaagaacaacaacatccaaccaatacagatctatacagcaaag

SEQ ID NO: 928 - DNA, 121 bp, Gadus morhua
aagataggctaatctacaatcagatcaatrcatcaggaagctggcttgaaggccatgaggktaaagacagtcatgtcttgtgggtagttattctacattatcacattcataggcagtaaaa

SEQ ID NO: 929 - DNA, 121 bp, Gadus morhua
cttytccaggtccctcacaagccgagcctggatcttctggaatgacttcagctgaggtackggaacgaagatgatcatggcctttctgctcgcctccaacatcaatttcctttgcagcggt

SEQ ID NO: 930 - DNA, 121 bp, Gadus morhua
ataatcccaccaattctataataaccagttttttctgaatgcttaaaacctgtgattcctwagaggctgtccctgaaaccattaacacttgccaatacctttaccaagtaagccaaactga

SEQ ID NO: 931 - DNA, 121 bp, Gadus morhua
gggatagagaccttggaaccagcccctcagagaacacctcctacagtattctgcgaccgcwcgaaaatgaccaacaaaaaaattaaagatcctacctatgatgtagatattcaaaattgta

SEQ ID NO: 932 - DNA, 121 bp, Gadus morhua
atgtagcttctagttactgaaccacaacagccttcactgaagacaaagtaacaagcagaaygatctgtactccccagctaatcgaggacacaagctacaagctaaagaaacaactcctctt

SEQ ID NO: 933 - DNA, 121 bp, Gadus morhua
tcttgggctttttgactttggtagcgggtgtggcgggttgctcctcttcttcctcctccasctcctcaaacttcctcttcttggaggtgctgggaatcgtggagtcggcggaggggtcgta

SEQ ID NO: 934 - DNA, 121 bp, Gadus morhua
aagcaaacttttgctgtgttaacaaaaaaaataaaagaatcacataattgccttgcaaccygctaaattaatagcaatgctgtgagttaatctaaaaccagagccccgtggaacatgcaaa

SEQ ID NO: 935 - DNA, 121 bp, Gadus morhua
atgataattatacactgcattacaacacaaagtggaacttaacgttaaggagcaacttgcrggttggcaatagcagggtcgcccatttaatgaggggaacagtctgcattaaatctgtttc

SEQ ID NO: 936 - DNA, 121 bp, Gadus morhua
attaattgattcattttctaatagtgtaaggagaggttcacacaacagtccaacttgtagmgcgagagatatttagcaggttaagatttgatagtgaatgatgaccgtatctatacaatta

SEQ ID NO: 937 - DNA, 121 bp, Gadus morhua
tgattaaaattgaatgtaatatgacataagaggcgaaaaatgaacagatagacagatttayagatatagatacatgaatatattgatccattgatggatagatagacagagatggatagcc

SEQ ID NO: 938 - DNA, 121 bp, Gadus morhua
tctacaggggacatgagataatactcctaaaaagtaccatcaatgaattaaacaattcaaragttagcctaccttacagtacttccacccgagattagaaaaaaaaaatacaatacataca

SEQ ID NO: 939 - DNA, 121 bp, Gadus morhua
caaatttaaaatggatgcctgaacagtggaaattgggacgagttaacggctgcttgtcaawggtggtgaaaaagaagagagagagagagtaatgctggaggatgatccaacaaggggcggc

SEQ ID NO: 940 - DNA, 121 bp, Gadus morhua
tttcaaagttaacggcatttatttaaaagttgtttagaacaggcaaaaaagagaacgaatkaaaaacaaactccttaacatgggctgctgtaccccggaaatgtgtaacatttatcattaa

SEQ ID NO: 941 - DNA, 121 bp, Gadus morhua
gattyatacaatgtttgacactatcaacctagttttgatgtttcatcagaacaaggcgttrccgtgtggtcagaacacatttacgccgtacaatacgatgggacaagkggagagggttgtc

SEQ ID NO: 942 - DNA, 121 bp, Gadus morhua
gttacatcctttggtcacaaggatgacccaaaaagggaacgtaacagcgtaaaaaaacatkttattattatagaacttgaatcaaaaagagcgaaaacccaactgtctaaygatggatgta

SEQ ID NO: 943 - DNA, 121 bp, Gadus morhua
ctgaacctagggacctctctgagctgattggcaagcagagctgtcagcagacgggccggcwgtgtattctaaggactagacaaacagcgccscctgctgggcacactgaactattaacaaa

SEQ ID NO: 944 - DNA, 121 bp, Gadus morhua
ctgcattataattgatgaattctaacggtcccatagaaggcaccaaggaatcatctccttwagtaaaacagtagataactcacaaaacagttaaaaaaaaaaatcacaaactaggaaacct

SEQ ID NO: 945 - DNA, 121 bp, Gadus morhua
ttgttttttcacattgtgagtaaaaacacaaatccggaatacaagtacaacagattaaaarcacaccccaccataaccaagggactactcgctgactgagtggtataaaccaacagaccca

SEQ ID NO: 946 - DNA, 121 bp, Gadus morhua
atcgtcagcctccaagggaaaagccctggtgtgcaactacaatagacttcagggaccatarggtccaacagcctctgcagcaacgcattgtttgaacacacaagtaagtgtcgctgtcacc

SEQ ID NO: 947 - DNA, 121 bp, Gadus morhua
gaagttgatccaacaaacggttatctagggacacgagtgtgtggatcccaggtatacaacragaaaggataaccgatattgaatatcgaggaagcttttttaaaaaccgttatatcatcgt

SEQ ID NO: 948 - DNA, 121 bp, Gadus morhua
tctcctataaacgtgggaaaaggactgctctggtttttaagaacattagcaaaatgcactycccaaaccttccataccaaacgcagtaattgttgccctcgactcaaaccgataaccggaa

SEQ ID NO: 949 - DNA, 121 bp, Gadus morhua
ggtcagggcatacatttaaacacatcaatctacattgaaagcaacaggtcagctccttcaraaaatttaaaatgcctttaggaatatggatgagttctttacaaaaacgacgtgaaaaggc

SEQ ID NO: 950 - DNA, 121 bp, Gadus morhua
tatactgtgtatatatttggtaagaattctccttgtacactccatacacaatgagcatgaygtcgcagaatacagaccataaatcgacctgaagtgtttgaaatgggtttctatatacata

SEQ ID NO: 951 - DNA, 121 bp, Gadus morhua
tcatcttataaatacaaaatgtacatttccccgctcgcctagacttctagatatatgttgwgattgttccgttatgcagaactctgtgatacattcgtggcagtgcttcccggctgcttaa

SEQ ID NO: 952 - DNA, 121 bp, Gadus morhua
atatcaccagatccatcattttaaaacattgaaatttgacttattggaggatgggcttggrgaagtgtgaacactgatcaaaaaaggggacgaggactcagttgtccacagcccctatata

SEQ ID NO: 953 - DNA, 121 bp, Gadus morhua
atctttttattttatctttttacaaaacatcacgtctaaaccattgaaacccctaccactycatcttctggcagaacataatcaatttcctttcatggataggcttgttagacacacaatg

SEQ ID NO: 954 - DNA, 121 bp, Gadus morhua
agattacaacgagtcagggtcaatctttattatttaaaacgcatttacagacggctgagcygcaccaaagtgcttaaacgcaagaaatggactgaggcaaaaagaaaaacaagtaaagggt

SEQ ID NO: 955 - DNA, 121 bp, Gadus morhua
ctgcaatcacttcaagtaattttggtaagagactttatcatatagaagcctttattcctgrtcttgtaaatattttgggtgaaatagacagtatgtgcctttttaaccagtggctctgtaa

SEQ ID NO: 956 - DNA, 121 bp, Gadus morhua
atgctttactgtgctgacaatgcatcgatggtacattaataacagcccaaagggacatctyctaaatggatttcctaacaattggaatacatgtgttaaaaagtcacgtcaaagccgtgtt

SEQ ID NO: 957 - DNA, 121 bp, Gadus morhua
tatttgatcttaatacatacaggtccatctttctgtgtgtctacatccctctcaaacaacrtctttctttcgtaatgcatgttgcaatttaaaaaataaagcataagtgtgtgtttttttt

SEQ ID NO: 958 - DNA, 121 bp, Gadus morhua
caaaaaaaatgtacctaattttcatatacattcacttgagtgaaccaacatgaaacaaaamatttcagcacaaagtaaagggacccaagaaacccttcctctgacgaccttttcctgagaa

SEQ ID NO: 959 - DNA, 121 bp, Gadus morhua
cttggaatgaaacaaaattaaggaacgaaccgaaggaattgcagcattaagggtcacaggrtcgcacagcattcggttcagcaatgtctcttggaaccccctttggttaatttgctttgca

SEQ ID NO: 960 - DNA, 121 bp, Gadus morhua
tacctcaagccctcatatgacattccttaccgaaaacagaaacatgttcaaaacaagatasatacagatgaattttgtcttaattccattaatttaaccaatacaaaaagataataggtgc

SEQ ID NO: 961 - DNA, 121 bp, Gadus morhua
tagttcagtacaaaaacatatcacaaatgattccatatccaatcattgctatagaaggatygctatctaatggtgcaagctccacatgtgtcctacataattcacaatttgatcacacagc

SEQ ID NO: 962 - DNA, 121 bp, Gadus morhua
ctggtgagggtcagccctatccatacatgggataatagaggcatcatttaaatacccctcyctcaggggaaaaacatttcacttggtcgagcaggtaggaaccgttgtaaacagcaaggcg

SEQ ID NO: 963 - DNA, 121 bp, Gadus morhua
acaggacagaagatgcgagcagagtacagtgagactggccgcacacaggcaaccaactctyttaaccagtggctgaaacatggaccggttcacaacttggcatgacatgagcgacacacaa

SEQ ID NO: 964 - DNA, 121 bp, Gadus morhua
aaaaatatatatatgtcgagtcatgtgtctctgaaacgacagtcttctcgttccgactccycgtctgactcctctagcaactcaaggcgagctcttttagctgctctgacacccagtgagg

SEQ ID NO: 965 - DNA, 121 bp, Gadus morhua
ttgttctgttccagctaaataatatacattcaactcaacaaaactgaaatgagtatacacrcaaacataatttaaaacactgcacttttcctttcataagttgaaaatgaaatcacccact

SEQ ID NO: 966 - DNA, 121 bp, Gadus morhua
aaacacagtcgttaacttatgatttaaatgagaactattccgctaataccaacatataaaygtggtcgtgtgatgaggatttgtgtaaaatcaaccccttagtcatccccaaagcatgggt

SEQ ID NO: 967 - DNA, 121 bp, Gadus morhua
gtttcgcagaagaggtaatgtcaaagataatacttctgaggtaaataactttattttaaasaccacagtcgcaccatttaaaactaaacagttttctaaactagttgaaggaaagatctta

SEQ ID NO: 968 - DNA, 121 bp, Gadus morhua
gtgtaactggtgattccgagcccgaccactttctactcagaccttgtacttctccttggcytcctctgtcagcacgcagatgtgattgagatctctgaagtattgcgttgtagtccagcgc

SEQ ID NO: 969 - DNA, 121 bp, Gadus morhua
aggggggaaggttgtaattattctttaaacctgcaccgtaactttttcaaagcagcaatamcttttgctcaaagatgttagaattttttgagcgcccatggagaattattgttctttctaa

SEQ ID NO: 970 - DNA, 121 bp, Gadus morhua
gccacgtccactaaacgacccaacgtacgcgtctctgtgcacgtgagcataactgtggcawaacggaggtagaaactgtcctttacaaagaagtcaatgtttctctttggcaaaaaacaaa

SEQ ID NO: 971 - DNA, 121 bp, Gadus morhua
tccctagttatgttaagcagctttgttctaacaaaatgtattttggttccaagtgcgagcycagtcccatccactcaggacctgttgtatatcattatactggtaaaagacagtagatccc

SEQ ID NO: 972 - DNA, 121 bp, Gadus morhua
aggtcaaaacataccaagagcatggaagcaagggactaccaccattgaattgttactgtcmatgtattggatctgatgcctggggggaaggggtagcgttagggtctcatgtgcagttcat

SEQ ID NO: 973 - DNA, 121 bp, Gadus morhua
cggattaacattaacatgtgtcatttagcaaataatgctaagggtaaaaggcaggctacamatttacataaaaagaggatatctgtcactttcctcacaacaatacaaaaagcaacacgtc

SEQ ID NO: 974 - DNA, 121 bp, Gadus morhua
tactgtgtgaaatgagtcaaccctttagaccttcactaatgaaattaaataattcagccargcatcttcagtcgcagggccatacgatggctaaatcccaaattgactgtattggaacagt

SEQ ID NO: 975 - DNA, 121 bp, Gadus morhua
ttgaccacaacttgctgctaaatgaaatacagaggggcagactcggaggaacagcgctacrttttagagttaacgattcattcttaatttacggtgaaccattgatcaccatcaacatgga

SEQ ID NO: 976 - DNA, 121 bp, Gadus morhua
caaataattaattaaaataaatcaccctaacaacacacgctttacacacacacacacacaygtttgtttttgatcaatcgagtgagagagaatttcggattgtttttgcttgttgttacca

SEQ ID NO: 977 - DNA, 121 bp, Gadus morhua
taaaacaactccgaggatcagatgatgtgtgtgtcttaatgacttcaggtggaagaaccamcagctttagtatttgtcccaattactagtagctagtccattcctgaaagataagtgatag

SEQ ID NO: 978 - DNA, 121 bp, Gadus morhua
tacttaaataagttcactcagttcactaacagggatatgcttccctctacaggtagaactkggtaagtgcactgttccttctgactattatctaaagtcatrtctagaaagcaatttgaat

SEQ ID NO: 979 - DNA, 121 bp, Gadus morhua
catagcagtaacattggttgacatttacacaaaccaaaacacactcgaatggaaggaatcwaacgtcatggactcacgtctgtaggcctactccccgtgtactaacctcttaagacgaact

SEQ ID NO: 980 - DNA, 121 bp, Gadus morhua
taatcagagatcgactttttccatttcttctttctttcttctccaattttttgaaagtgcygatttgtgcaaagatcactgaagcacaaaccgcctattctgccaacccctctagtgcatc

SEQ ID NO: 981 - DNA, 121 bp, Gadus morhua
aaataaatcacattattgctcttcaaaaaataagaaaatatatgaatcacgtttcctttcmttctcaatccgaatccttctcaaacctcatcctgatataagtccttattgaaaatagaaa

SEQ ID NO: 982 - DNA, 121 bp, Gadus morhua
atggcatcagagatgcactggtcctcgttacccacattgtctccaaacactcctaactaargaaaaagggcatctccttgagtcacacacctcggaggacaccataaataggatacgatgg

SEQ ID NO: 983 - DNA, 121 bp, Gadus morhua
gtcttctcaagacgctcaacaacgtaaccactgatggggcttccaccgtcagtgactggcktggaccaagttagagtcattgaatctccagttacttcgggtgacctcaacactgaaagga

SEQ ID NO: 984 - DNA, 121 bp, Gadus morhua
ggatggaatagccaaaaaacaaagccaaacaattttcacgtagtgcaactaaaagggttcmctgggaccagctttgccatgtgtgtcacgaagttccggttgatccaatatgtctgctgca

SEQ ID NO: 985 - DNA, 121 bp, Gadus morhua
aacagttgtaagagtatcaacttttgtttgaccaaacggtaaccatgtaacaaacagaccwataatattttttttagatggcgacatacccaatactcgacaataattagagcgagcttcc

SEQ ID NO: 986 - DNA, 121 bp, Gadus morhua
acaacactcatgctttaggatatgtctgtggatagcagcctattatagcggccttccttgwttgatacatcaaacagccaatcaccaagatgtgttattctgaaattaacmaatgggaagt

SEQ ID NO: 987 - DNA, 121 bp, Gadus morhua
gcagggcttaaataaccgaggatcaatgatcacctccccaaaccgtcctttgtagacaatrccacagcatatcttctgtcttttccagtaggagcggtcaaggaaagagaaggcagtggga

SEQ ID NO: 988 - DNA, 121 bp, Gadus morhua
caacagtcaatgtgtgcataatcgaataatagaccaacggctctgtaaaaaaaagaaataytctcttctcttggcgtcttttccattgttttccatttttgaacacattacttttaaaaac

SEQ ID NO: 989 - DNA, 121 bp, Gadus morhua
acaaatgagcacatcttagtttcttattggcgtgatgctggagtattctacagtgcctacrcaccgggtaacgaagaatcaaatatagtcccgaccttccatgcttctcatggtttacaac

SEQ ID NO: 990 - DNA, 121 bp, Gadus morhua
aaaaactaaaacaaataaatgaaggcaccgttggaagtgtctgagccaaccaacagctctraggtaagtagtaggtttcctctggtagactgttacctcttctgggttttcttggcctgct

SEQ ID NO: 991 - DNA, 121 bp, Gadus morhua
ttgcttttgttcttgaagccacaaaataaataagcctacagagaaataagacaatgttcawggtggtaatgagcatttccgtggtaagacgataatcggttgctcaagatggactaggggg

SEQ ID NO: 992 - DNA, 121 bp, Gadus morhua
agttatgatcacaacataaaatgcatttacagcatgctgagttagctcgttaagtccaggytagctagttaaactaggtcgggttagatctggatcaaactggtaactgcacgacgactga

SEQ ID NO: 993 - DNA, 121 bp, Gadus morhua
tctgtcattcatttgtactttcattcattcattcattcattcattcaaacatacatccatycgctcttgatttcacatgccatgcattcatcatccaccacaatccgtttccacaatstgg

SEQ ID NO: 994 - DNA, 121 bp, Gadus morhua
gtccatctttccctgccagctggctgccgtcttcgggtgtagacaggtgtgactcaatccracactcattcaacagtccgacgagtagacgagaacaaagtaaagacacacatacactcaa

SEQ ID NO: 995 - DNA, 121 bp, Gadus morhua
ggattctcgtgaatatatttacacactgtatggggtttgcgttaacgggactttaccataytagctgaacttgtaatcgttaacaaggatagtcaatgacacaggtcttagcatcgttaag

SEQ ID NO: 996 - DNA, 121 bp, Gadus morhua
tagtaaaaatgggataccaatgataacaacatgcaaattgtgtttgtgaggcgtcaaacartttgtacaactattgcatgtcccattagcaagtgtttataaatatcaggaaaatcwaact

SEQ ID NO: 997 - DNA, 121 bp, Gadus morhua
aaagtttttattgggttcccgtatatttacgtttcgtttggattttacagtagcctactawacatttcttgagccatcaaaaaatggcggagcatcgccaccagaaagtcctgtgatgcat

SEQ ID NO: 998 - DNA, 121 bp, Gadus morhua
gaaaaattaaaactgaaaaatgattgtgagacactgctatagaaactaaaggatggcgtgwaggaaagaaaaagagcgtccacaaggaacaccagtgcaatacggtaaaaacacatttgtt

SEQ ID NO: 999 - DNA, 121 bp, Gadus morhua
tagtcaatgttattgtttcacactagttagattagtctgaatggaatattgctaagttaarcattgtactaaataatgtttcagacatcattatttattacggcgatgtattaatatgaat

SEQ ID NO: 1000 - DNA, 121 bp, Gadus morhua
aaataatgtttcagacatcattatttattacggcgatgtattaatatgaatatatatattkgctgtgctccagatataacttgtgtattgtgtccggttcacagaagccgatcagcatgaa

SEQ ID NO: 1001 - DNA, 121 bp, Gadus morhua
acccctttttggtttacatattttttttttttttttacattcatctttcaaatggttgtasaagtcaaccaaattctatagaaaatgtagaggatttctccctgatggtgttggttttctt

SEQ ID NO: 1002 - DNA, 121 bp, Gadus morhua
ttcctcttcaaaatggtgtatttgctgttgatttatatcaaactgccctataacagcagaracctcgtccaatcacagcagggtgcaataaagataattagtagttagaaccgtatataaa

SEQ ID NO: 1003 - DNA, 121 bp, Gadus morhua
aatacgccccacccctcaccttgatgccccaccccaaggaggggaaaaaacggatgattgwaaagacatctatttacaagaagcactacatcacaccagcactgaataaaataggcctcaa

SEQ ID NO: 1004 - DNA, 121 bp, Gadus morhua
tgcaaccggatcttctgtttcacaattagaccaaaacaaaagcgtttgacgggatttgacratgaaaaataagagtgcgaaagagatcaactcaacattttttaattgatatactttttca

SEQ ID NO: 1005 - DNA, 121 bp, Gadus morhua
atatggagcatcccattcttcatgtgcaccaataaatacaacacaatcagcatcaatactkgcaaaatacacggtcagcatacatagaacctcagatattcagtgcagcatatcagaatat

SEQ ID NO: 1006 - DNA, 121 bp, Gadus morhua
ttccattttagcttttgctcttgcttttgacaaatccaatcttttaataaccacattatgyctttgtattctaaacacaagccttccctttctccaaaccccacacattacgattccaaaa

SEQ ID NO: 1007 - DNA, 121 bp, Gadus morhua
gtgctgataaacaacccagaaataaatacaagcagaaaatatgtgtccttaaaccatgggytttagaaaacaacggtagctaatgaaaagacacaatccgaaaatcgtcagccttctggaa

SEQ ID NO: 1008 - DNA, 121 bp, Gadus morhua
ctaratcacctcccctatcacttaatgcagctcattctggctgtagtgttgggatgctggwgtgatggtttatattccattgaacaacaaaaaaggaaaatttgaaatgaaaggaaatctg

SEQ ID NO: 1009 - DNA, 121 bp, Gadus morhua
agatttgaaattgctgccatcattacatgtttcacttctgagcagccggtctggagatccyatgttaacaatcacagccttttgatcgccaaatgagggctcatggtagcggcaatgtatg

SEQ ID NO: 1010 - DNA, 121 bp, Gadus morhua
agaactctttagaaaaatagtggtttataatgaagcacgaaataacaataacaagtgttgytctcagaaaggaagtgaaacgtgtaccagttgatgctaaaggtgtgatttctgtcactaa

SEQ ID NO: 1011 - DNA, 121 bp, Gadus morhua
tattttatgatagcactttcttattattcatagtcatatttctattgtacatttgtcggtktataattatcataaatattgactaaaagctcatccaaaagtccttaattgtagttcttca

SEQ ID NO: 1012 - DNA, 121 bp, Gadus morhua
ggttacatcagttgagatataactaaatacatagaaaaaaaacagcatgacataaattatsgacttaaatcaaaaaattaaattaaatttgggacatttataaatcagggtgtttaaacga

SEQ ID NO: 1013 - DNA, 121 bp, Gadus morhua
agtgtaaaagcctacctcaggtcaagcagcgataagcgctaccatgtgtaaagaacaccaraggtaatcttgttcacgggctcttaaagctacactgtcacataaatccaatttcaccaca

SEQ ID NO: 1014 - DNA, 121 bp, Gadus morhua
aatcaacccatacattaaatactagattaaagtgcaggaaaggggaaaatgaaacatttgkcgtgaaaggtgcttttccgaagaaccatcttggtgtattttggctaaccattttcaaact

SEQ ID NO: 1015 - DNA, 121 bp, Gadus morhua
caatttctcaaatgtaaactgaaaacatacaatgaactaacagctaggcctacccgaaatktgttaacattatcaacacaaccagtctcataaaaagcaattacatattttagttgaacat

SEQ ID NO: 1016 - DNA, 121 bp, Gadus morhua
cgggcagacatacgacgttcaaaattcagaattctattacagtggcaagagcatttagaamctttccaataaggggagacaacgggtctcaacacttaagggggtcaggggcgattaaaat

SEQ ID NO: 1017 - DNA, 121 bp, Gadus morhua
atggactggtccatcaaagcgtaaatcgatatagcttaaacatttcatatccttctaactwggcccaccaaatgcaacagttttaagaaagcacaattgggagctamgccctcaaaacgaa

SEQ ID NO: 1018 - DNA, 121 bp, Gadus morhua
atgcaatatcccaaaaagaaatacttgaatatcatcaaataacacatgaaatgctgaaacstgtgcacagttttgtgttgtcagttaaaaaaaaaggttatttacaaaatgaacccctccg

SEQ ID NO: 1019 - DNA, 121 bp, Gadus morhua
gtttcagagaacaaacaataatcaatgtatattgattttgccatagtttatttaatcctcyactctgcattgctgagattccagcgcgaaactcattcataatgcatgcagaggattagcc

SEQ ID NO: 1020 - DNA, 121 bp, Gadus morhua
ccatagagcaacttctgctatagcaaatacttcaaacttggctaaacaacgcaaaaaaaamacatttagatcttcaaattggatacaaatataccctgtgttggctgaaagtcagatctaa

SEQ ID NO: 1021 - DNA, 121 bp, Gadus morhua
aattggcatgtggttgaatttgtagcaaaggaggccaacacatttattttattaggtcaawgggtttttcaactgggtctttgaacaaccacagccaaaagtagtctgttattaaactata

SEQ ID NO: 1022 - DNA, 121 bp, Gadus morhua
tgtaaagtaatcctcagacgttatttaaacgtgcatttcattttaaggaactgggggtgcytggtaatttgtaaacaaacattattcaacacttgcctgctgtggattcgaaaaatcgaac

SEQ ID NO: 1023 - DNA, 121 bp, Gadus morhua
ggaacaatagagctagattaataagcctaaatatataaaggttaaactggccaatgggcarggtgcgagctttcaatcaggtggctggtacagcctgtttgacttgcaaatgtgatttgct

SEQ ID NO: 1024 - DNA, 121 bp, Gadus morhua
ctccatggcctcctgtccacctcccatcaccacgtggtccatgatgggcgaaatggccgcwgagttaacgggtckctcagttttgaaggtcttgatgtgatccagagttgtggagtcaaac

SEQ ID NO: 1025 - DNA, 121 bp, Gadus morhua
gacaatattcttaaggttttaaatttatacaacaaataaacttaaatgccagcaagaaatraaatacaaatgtttgcatatggtgacatttcctaaggataaaacttgcaagtaaatgtgc

SEQ ID NO: 1026 - DNA, 121 bp, Gadus morhua
tccaggcccaaatggtatccaaatccaaatggaaaacagttttcttctgaatgaaataaawctctttccaggttgttgtttgtccttagttttgtgactccaaagccatttctttcaataa

SEQ ID NO: 1027 - DNA, 121 bp, Gadus morhua
ttctgctttcaatgtgttcaagttttaacgtggatggggtttaagtatgccctctgcaggrttctccctgacttgagtgtagggagaccagctcgtgttaggtactgaggaagattagtcg

SEQ ID NO: 1028 - DNA, 121 bp, Gadus morhua
atttatcatcctcaagcagcggatagaagaacaatacaagaggtggaaaaccttcggatasacagctgaagtggtttgttaacctcgggcacttgttgtatttagacgaggcctcacaaac

SEQ ID NO: 1029 - DNA, 121 bp, Gadus morhua
acagcttagttctgctgatcctctaaagaataaatgggaatataagacactttttccaaarctcagactacgactacagcaccctctcggaactccactggttactgcaacagcttttcct

SEQ ID NO: 1030 - DNA, 121 bp, Gadus morhua
agtaaagcaatccttatccgagtttgaaagcaatttacacagtaatgtgaagccttttacrgagcacacttggtttaaagggagtcgaaggaacttgtagcacaatcaacaacaactgata

SEQ ID NO: 1031 - DNA, 121 bp, Gadus morhua
atagaatacatttcaggaacggaaaacaattcaatacaaataaagactgaattaacccaamaccaccactctcttcctgtaccaacaaaccgccaacacccttcgcaccgcaggcgttaaa

SEQ ID NO: 1032 - DNA, 121 bp, Gadus morhua
aggtttgcctatgtcatcaagtcacccccactaacccaaaagaccacccactcacaccccyactctcccacaggggctgctacgtttcttattgccacctaccagtttgaatcttataaaa

SEQ ID NO: 1033 - DNA, 121 bp, Gadus morhua
cccttctttgaagcaaacaagcatcttgaggtcaatgtgtaccactgtgggacttcctctrtatcactctattggttaaaaggtctttatggcatgtaatcaacgccacatgaacatattc

SEQ ID NO: 1034 - DNA, 121 bp, Gadus morhua
ttctacaatgggagattgtctagaactggagggctagagatgagttggacttatgtacgtrtactcccaccccaacgttttttctgccaaggaaaacacatactataatagtaatcagtta

SEQ ID NO: 1035 - DNA, 121 bp, Gadus morhua
tgtagcaatgcaattctctagctagcagaactctaaggctgaatccgaatacttagtacawactatttcttttcagtgtctactgcttgacggtactacacttgacagtgtagtacggtct

SEQ ID NO: 1036 - DNA, 121 bp, Gadus morhua
ccctaagatgccggcaaaattaccttgataagtttcctgttttccgtcttgtcatcgttgmtattcaattaaaaatgtctctttttacttaattacttactttactttatttttactattt

SEQ ID NO: 1037 - DNA, 121 bp, Gadus morhua
ttccaatgttttgtttttattcaaccttctacccaacatgtccgttaccaacaaggtcctygttacatcagtgcttatacttcatggtaaggcccaacagggcttctcccctacaggggta

SEQ ID NO: 1038 - DNA, 121 bp, Gadus morhua
gaacactagtgacacacaggtgtcttctgtaaatcacatggaacccatcagaaatccaccygtgcagttaaatgtgattctactttagtgacatcactaatgaaacacctcaccaggtgga

SEQ ID NO: 1039 - DNA, 121 bp, Gadus morhua
tagcacctcggtgagcccgagttggaaggttaaaggtgttaaacttcacatgagtgttatytgttacatgttaggcagaagagataagattaatatcacaacaatctcgcgatctgatagt

SEQ ID NO: 1040 - DNA, 121 bp, Gadus morhua
gtgaaagatagttcggccatagttccttacgtataaacgaatagacaaggtaaaaactttrtaattgaagtgggtgcagaagttgackgcaaggaaatgaacgacgacaaaactccacagc

SEQ ID NO: 1041 - DNA, 121 bp, Gadus morhua
aaaatagggtcaagtaatcttatgaggcataacagaaagatcccttaatttatttgtgccwtctgttatgttaacagggcagccaggcgaaggattaactactagcagttcaacacaaaaa

SEQ ID NO: 1042 - DNA, 121 bp, Gadus morhua
tgactgggaccacacatcaggtccaaccattaagggtgggggttagaaacttataaaccaraggggggcaaaataaatgaaaaatataaccataaagacctccgtccttttggctaacaca

SEQ ID NO: 1043 - DNA, 121 bp, Gadus morhua
taattcacaggacaattaaccctaccacgaagataagctggtcggaggacaacgtaggaaygtcagaacacaataataacaaacaaaataaagatatcaaaaattattctttgaaactaac

SEQ ID NO: 1044 - DNA, 121 bp, Gadus morhua
taaagtgcttggttaccagtgtgtcaggggctatcacggatcgacacgagaacgtacacaygtcaaacagataagcaaattcagcgactacagagtggacctcccaaccagtggacatggc

SEQ ID NO: 1045 - DNA, 121 bp, Gadus morhua
ctataattggtacattatatattcgatacataatcattttagtaataagcacaattgcatwacaagcagtcgaatatagacgagacatttaactggcattgtttaactgatgagtcaatcc

SEQ ID NO: 1046 - DNA, 121 bp, Gadus morhua
aaatgtgcatccgcctaatgctgagctttccagttccgagtctgcatttataagagccaayattgtttcaaaccctcacaaaccaaggaaacaacataattaattcctctcgtggacaaat

SEQ ID NO: 1047 - DNA, 121 bp, Gadus morhua
gccaaacaaactagcaaaaggaaaaataatagttgacacatcatctcaaccataccaagcmatgcccaaacaatcgagagggaactgtgaacataaaagttcaatggacatgttgccaaag

SEQ ID NO: 1048 - DNA, 121 bp, Gadus morhua
taaatatttacatggctctcaaatacaaacttcaattgccttacaggcaagaacaaacacwttacaggaacagttgcagacgggtgacacagtcagacactagtgcgacagacggtcagta

SEQ ID NO: 1049 - DNA, 121 bp, Gadus morhua
tacaactatcaaacccccgcttcatataagattgaaccccccccccccatatatatatatwtwtaaaaataatgacaaataaaagcttttaccatcaaaagacaaggccaccatcaacacc

SEQ ID NO: 1050 - DNA, 121 bp, Gadus morhua
caagtgttcagcactacaccaaacggaatgaacagcaagcgaacagtggaatgccgagtgwattgtcaagtagagcagaacctggacggaacaaaaacatgtgaatatacaaacaagtgca

SEQ ID NO: 1051 - DNA, 121 bp, Gadus morhua
aacatcgacacttgcttgaaaaggattgctttcttgtaaaaatactaaaattctttcccaraaagtactgtacaagataaaaattgcacaaggaatcctaaaaagagagcttcactattgg

SEQ ID NO: 1052 - DNA, 121 bp, Gadus morhua
ttgtgtctggtgtctgtaatgttctgatttctacgtaaaacaaggcatccagtggtacatwaatgtttacaaagttaaggtgcaatgctgatgtggagaaacccagatatcttacatctaa

SEQ ID NO: 1053 - DNA, 121 bp, Gadus morhua
gaacatagcttgcattagccaacaaccaactatctggcattagtcaacacacagccacctrgccttaaacaacacacagctaagcaacacagcgctatgttgcgtaagcaaacacacaact

SEQ ID NO: 1054 - DNA, 121 bp, Gadus morhua
tgcaaaacaactggaagacattcatgtgggagcttcattgaaaaccacaaagcagataggwctttatggaatctctctctctgtctcggagagaaataagatcgattttgcgggtgtatgc

SEQ ID NO: 1055 - DNA, 121 bp, Gadus morhua
ttgtatattactgttacaagaactctttaacgagacaacttaatcttagcatccatccctwtgacctcgattgcaaaatgctttcttgatgaggtgagtggtcaaaggtggtgatacattg

SEQ ID NO: 1056 - DNA, 121 bp, Gadus morhua
tggtgtatgcaatagaaattgatcaacgtttcaaggagcctcagatctatttctcccagcwgatgaagagctggttctgttttcacaagcagtactgtttatatcgacttctacttcatct

SEQ ID NO: 1057 - DNA, 121 bp, Gadus morhua
agcgcaacaacaaacgtttgttggtggttactgatgaattatagctgttgctgtacactawtctgatagcagcttcaacatttgaggagcaaaataaaatacaaaagataaaaataaaata

SEQ ID NO: 1058 - DNA, 121 bp, Gadus morhua
attgtttcatacttttaaacacaagctctctgagaccagatgacataacaaaataaaccamccccctcccaaaaaaaaaaagaagctcaamcaaaaaaaccaaaatctctttactgcatct

SEQ ID NO: 1059 - DNA, 121 bp, Gadus morhua
gcagaataatgtatgagatgattcatgttgaaaatgtacatattaaatgtgtttcttaaamattgtatagactttatgcttgtcttgtgcctaaattgtacaggagattcaattcccatca

SEQ ID NO: 1060 - DNA, 121 bp, Gadus morhua
ctttggtttagcatagtagcagcactgcaatacatcactagagacccatttttccacagaytccactggcatccttaacacaatgggaagacccatgtacagcctgaacaaaaccttgtta

SEQ ID NO: 1061 - DNA, 121 bp, Gadus morhua
attaaagtaaagtaggcattgaaaatatttgaaaagcagcaactcttccaccatttagtgwgtgtgatattttagatcgaaggtccaaatattgatggatattctattgggtgccttgtat

SEQ ID NO: 1062 - DNA, 121 bp, Gadus morhua
aatttaaacaaaacgctttgtgtcgattgacctgggtccggaacttccacttcacggtcayacatttactgaacagcaaacaatacttgattcaaattgtcgcacattggggtcatcctgc

SEQ ID NO: 1063 - DNA, 121 bp, Gadus morhua
atttgcaactaccaaatgccttctggacgtttatcaagataaattaaacaagcacctccayttcaggatacaaaatcaacctggagcccgacaccatttgttcattctgatcacctattgg

SEQ ID NO: 1064 - DNA, 121 bp, Gadus morhua
acaaacacatcagttaacttgcagttactggttacatccaagtagttctgtacgatccgtrccgggatgtatcattatcaacacactggcctttattaaaggtcgacaatatgttggctcc

SEQ ID NO: 1065 - DNA, 121 bp, Gadus morhua
agtttatttttgacaaaaatcttgtagcgatggtcccacattttatcacgcttaagtagtwtggatcgatcacatgaacatgattgatgacaatacagaggtagaaatagtaacatttgta

SEQ ID NO: 1066 - DNA, 121 bp, Gadus morhua
tctgaccatggctgttagagggtcagaaatgttgcattatattgtttcgacaaagatcaayctttatttcagcacagatcgccggctgtggtttgattagttatttttgtaccggttgatg

SEQ ID NO: 1067 - DNA, 121 bp, Gadus morhua
ccacctgtgttgctagggaacaatgaggttgttcatactttctaatggacgtagttcatcraggtaggaaagacagccttgagcgtgttgtagtaccagccccttaattgcttccaagtag

SEQ ID NO: 1068 - DNA, 121 bp, Gadus morhua
gaaaagttaaaaggttcaaaagtaaaacaggttccaccggtcacacattgacgtggagcgmgtggttcatacaatcagcgtttgttgaccatccacagacatctgcagcttttggtttaag

SEQ ID NO: 1069 - DNA, 121 bp, Gadus morhua
acacgcaaacttaagacttgaggtaactgtagaatccagtttggcctccgagaggtccatsggttcaccgtttcttgatgcgaccctgataataggtcttcctggctagagttggggtcca

SEQ ID NO: 1070 - DNA, 121 bp, Gadus morhua
aaagaaagaagtccaacactcggtaatgcagacagacaacatggcggtccaccatcacagygggtcagaccaccgaagacacgatctgaaaccacatcccggctcggccacacgtcaattt

SEQ ID NO: 1071 - DNA, 121 bp, Gadus morhua
agctgaggagaacggagccaggatgggactgacagctatatatacacactggatggtgtarcactgcatgacatatcagaatgtaacacacacgaacacacaacgtatgactcatatgtat

SEQ ID NO: 1072 - DNA, 121 bp, Gadus morhua
tcaactctaattcatccctgcagaaggtcctttaacctaggtgcacagtaaggcctctccrgtactgaataacatactagtggaagaactatctgctaacgactccaacgggaggccgtaa

SEQ ID NO: 1073 - DNA, 121 bp, Gadus morhua
tattacaacagcacatatatacagttgacaaagacatacaagtgcttgtatgcatggatgktgttgtgtgcatttagaagcacttcctgtggacaatggacggtcctgcctcatcatactc

SEQ ID NO: 1074 - DNA, 121 bp, Gadus morhua
gacacacgtcttttttatttttaacaccaagaactgtgcaacaaaaccttatttaaattcmccatactatcatccaacgaagaaagcctgacatctggtggttagtttgcggccgcgcaaa

SEQ ID NO: 1075 - DNA, 121 bp, Gadus morhua
atcatatatagggtttattttattgatttgaagttatttgattttatccccaggaaaaacytattgtaccaatatgccttacaatttggtccttgatttcactcaagactcaagatggttc

SEQ ID NO: 1076 - DNA, 121 bp, Gadus morhua
ttttttttcttaaggtgcaccataaaatcggcgagtgacatttcagttaaaactcgactartgcggcaccgatacaagaacacagagaatacttttgttgcacttatttttttgacttatt

SEQ ID NO: 1077 - DNA, 121 bp, Gadus morhua
gagaaaatacagtgatggtcacaagtcatccacaaaagtatgtataataatttaccgtaartggttctttatttgaacacaatcccattcagccagtgaagtgtttgcagcaaaaaaaggc

SEQ ID NO: 1078 - DNA, 121 bp, Gadus morhua
gacatcctttcaaattcggcctatattcaagtgggggctaagatcagtgagatcaggggtycattcataaaactgaaaaacatgggaaaccccccccttcatcctgtttaagacttaagcc

SEQ ID NO: 1079 - DNA, 121 bp, Gadus morhua
cacagttggacaactcggagaccctgttcagatcaggtccattagcatggccaggatcatragacacctctgtggcaaggaatcctcacccaaccagcttggtgcaacaaaggaaggacaa

SEQ ID NO: 1080 - DNA, 121 bp, Gadus morhua
aaacaaaaataaggtctaaaagactatcaaaataatccaaccggctgatgatcacctcatmaaaatacatttccattcgtcgtacagataagctttacatgaaataaacaataatacaggc

SEQ ID NO: 1081 - DNA, 121 bp, Gadus morhua
ccattttccccaccacacacatacaaacacactgagtatttcacccataattcaatgtaamttaacattgttaatcaagaagacagtatcataagacaggaatcatacagtgagtcaagct

SEQ ID NO: 1082 - DNA, 121 bp, Gadus morhua
tagcacaaggtggattgtgctttgaaaggctgacaagctgaggcaaggccctgtataagamatgaactccttaaagcggatatatttagcagaattgcttttatttacctttgttaaaaac

SEQ ID NO: 1083 - DNA, 121 bp, Gadus morhua
aactaatttccttctttttttttttacaggtcaagtctctcagggtttcttgatacgtctwgcagtatcttcttatcagcatttcacctcggaagagaagtattrgttagattatcagtgt

SEQ ID NO: 1084 - DNA, 121 bp, Gadus morhua
tggattttcttaaaacaaaatcagaatatgtgccagtgcaaaaaaaacaaaatttgaaatwgtcttttaatgaatcaaccccctatgtcccgaaaatggaagcagaataaaagcatgcgct

SEQ ID NO: 1085 - DNA, 121 bp, Gadus morhua
tggtggtcaaggtccacatgcacgttgtttttcaacaaaaatcataactaggatctaaaawatgttatcaagacagtcggtaatcagttccaaaccatgtgaggagattttaaaagttaaa

SEQ ID NO: 1086 - DNA, 121 bp, Gadus morhua
tggtccagctatagttagcatgaatgagtgaagggaaaaaatattcaagctaagaccagcwgtatgtgcattccctcaacttccccaatgtgagcaatggggaaaacacccatattcttta

SEQ ID NO: 1087 - DNA, 121 bp, Gadus morhua
ttggaatacataactcaagacaatagagaataatagcactgcttgtgtgatgaataaaaawaaataatacaagatactctgcaatgagacacgtagagaaattaagccgtatacaaattca

SEQ ID NO: 1088 - DNA, 121 bp, Gadus morhua
cagccttattatcggccatgttcaatactggtagtcctccaaccagtggacataataagcytccaacctgactttcttctcatacacttcccatagggcttgtcttcacaattcacattgc

SEQ ID NO: 1089 - DNA, 121 bp, Gadus morhua
aactaaaaaaaacagatcaaataattgatcaaccttctgaatctgactctggttgtttatrtgaccatggagacagcagggcgtagcaacgagtcatagccgggtagtagcagctccctgc

SEQ ID NO: 1090 - DNA, 121 bp, Gadus morhua
gtatttccatggacatttttcagatgtttcgattcagaaagattcttaaacaggaatacamcccatgcaaaatccaccattggatatcatttgaaaattaaaactagtgaatatggtggaa

SEQ ID NO: 1091 - DNA, 121 bp, Gadus morhua
agtcaagatctaaaccaccacagccatcgaggagttcgtcttagtaaaggacccaacaggytacaaataaacagggtgtcatggcctttaggtccgaaactacattacccagagtcttctg

SEQ ID NO: 1092 - DNA, 121 bp, Gadus morhua
ttacataaaccatccaaacattcataggtcgacatgtgaaggccataggcaggcggactcractgcactgatgttaccagacgaaccaacagaccatcccaacattcattggtcaacatgt

SEQ ID NO: 1093 - DNA, 121 bp, Gadus morhua
ctgctaaacgatgatcatcgatgttgacttcctgtttcctgttcgccgtatggacaacaayatacactgttctacacctgagcgtcttctccatgatcataaaaacgtaggatatagcatt

SEQ ID NO: 1094 - DNA, 121 bp, Gadus morhua
ttcaatgtcctttttaatatttatttttaatgcatcagacattgaaccacataattatccrtgtattacttgtgtagctataatgacaaaaaaaatgtgtacaatattaagaaatcaaaca

SEQ ID NO: 1095 - DNA, 121 bp, Gadus morhua
ccatgatgcaagctgaatggaaaaatgatcttccctcgcccccccccccctcatacatggscaattcacaaacacttaagcatagaactactaattctcagaacccttttcttgactcctg

SEQ ID NO: 1096 - DNA, 121 bp, Gadus morhua
agatataagaacggaaagcacccttaactacacttcgtacaactaaaatctggaaatgcargatcctgagctgtaggacatagagaccaaaacagaggtcacttttccaattgaatcgcaa

SEQ ID NO: 1097 - DNA, 121 bp, Gadus morhua
aaactgctctcctgattttgttttcatcccaacattcacacacacaaaaaaaaacacacaytaaccgaagctttccacttctgccattgttttcttgaattccaacgcaccgtacagaaaa

SEQ ID NO: 1098 - DNA, 121 bp, Gadus morhua
gagggtcctgactggagattctctttcaaagaacagcgaacacaggattacagggcaagaraacagtcacgggactaaaaagaatagacccaacaagtatatgacagagaagttaacaatc

SEQ ID NO: 1099 - DNA, 121 bp, Gadus morhua
gaaattacaacattgaaaggcaacagaaatacacggttatgctgactgtctacagttggtmaaaccacatcgtaaggccgctgaccacctctctgctcacctgagaccttgccaacaacac

SEQ ID NO: 1100 - DNA, 121 bp, Gadus morhua
ctcgtacctctgcaccagctactgtctcactttctccgatggcgtgttgtgttgcttttckttatttgtgccataaaacctggaaacctgacctgaaatagtaaaataccttcagcataga

SEQ ID NO: 1101 - DNA, 121 bp, Gadus morhua
cgtgcgtgtgtgtgtgtatgtgatggtaccactttcactaactgcgttaccaagtaactckgatgaacagaaagtttctccactgggaacaaaaactgttctcacttcagcatcaaaggag

SEQ ID NO: 1102 - DNA, 121 bp, Gadus morhua
gtactccttcctgtgatcttttgtggagatgtgctgtcaaaagggtggcataactgtcaamgcaagaattcagtaatgtcggaacatttagtacccaaacgagtttcacgccacttcgttt

SEQ ID NO: 1103 - DNA, 121 bp, Gadus morhua
cctttttttctctctcaactttgggaaacaaagcaggggcagtgctcgctacggcaggagygccgaccgatgtgtaaaaggggtgagcctggtgaaatcaggactggttgttacagtgggt

SEQ ID NO: 1104 - DNA, 121 bp, Gadus morhua
taggttccctgtttgagcagctaaacttgatcacagttgagttttcttttgagtattgctmgaagaataaatccttaccaccggctagtgcttgcacaacagggtctctgcttggttccac

SEQ ID NO: 1105 - DNA, 121 bp, Gadus morhua
agtctcacgggcactcccttggggaaccccgaggggaccgtggctaggggcagagtgggtscgctactggtacagtgtacacgtgggtcggtagtagtattgggaggaacatgttttttgg

SEQ ID NO: 1106 - DNA, 121 bp, Gadus morhua
ccatgttttagaacacagacttaaggaaagctcctacaaggaacctctcagttagctcgcwgggctagcataggcctgaatgttcataagcacacaaaacaccrgatggcaacagttgaca

SEQ ID NO: 1107 - DNA, 121 bp, Gadus morhua
caggttgttgttgttgctgctgctgccggcccgaaaataagaaaacgcttttgtgtgttayggtaacactggccgaccgagaccatcgtacactcccgggttaacgccatttataccctgc

SEQ ID NO: 1108 - DNA, 121 bp, Gadus morhua
tttccctgaaaatgcagattgaggaagcgtacagtaaaatgatttgcgtttacattcacakgaaatggctgctctctagtggacaaacaggagtatgccattgtagtcaattacataagtt

SEQ ID NO: 1109 - DNA, 121 bp, Gadus morhua
caaaccaccaagacccctttagcccagtgatgcccamgagacaaggtgttgcaagagggckgggagatgtgcctatttgttttctgtgctatcgatcaccggttcaaccctttacgtckaa

SEQ ID NO: 1110 - DNA, 121 bp, Gadus morhua
gaaagacgattatgcaaatcatcagctaaactgagggctgtaaccaaaaaagaaaaaaaaragaaaaaacagttgtcgttcttctacaacttctaaccattgtgttgtcgaaacacaaaag

SEQ ID NO: 1111 - DNA, 121 bp, Gadus morhua
ggaagaccaccttttttcacaacaaactaagcatattctaagtgcttccagttccatctgrtgctaacatgtcactgtatatagcctgatatctccgtaccctttatgtttaatctagttt

SEQ ID NO: 1112 - DNA, 121 bp, Gadus morhua
aaaatacattgttataaattagagcaaaattatctgggcctttccccccaaaaatagcagmatccaattattcaaagtatgttgttttgtgagctttggcctacacacgttttttgtttgc

SEQ ID NO: 1113 - DNA, 121 bp, Gadus morhua
aagtaatgaagtaaaactagcatgtttatatgtaaaatgtctgaacatgaccaacaacacmacatgttacagaagacaggtgattctcaatgaccttcagttgcagtactttgatataacc

SEQ ID NO: 1114 - DNA, 121 bp, Gadus morhua
gtagttaaattacaaaaaagcacgaaaggaacagcttatttgcaagacacttgagtaagaygactgcatgactccatcctaggtctttgaacctacacctgtgctacgcgtatgacatcag

SEQ ID NO: 1115 - DNA, 121 bp, Gadus morhua
gtaaggcaagatgtattaggcaaaacataacatgttaagataccttgtttgattaaaacawttacacatgtagtcatttggtaactgcttgctgctggagcatgagcacatttctatagtc

SEQ ID NO: 1116 - DNA, 121 bp, Gadus morhua
gagtcaaatccatctgcattaatagatttcaaacaatgaatcaacttagctttcggsgatkgagtgcaccacaaactgcaaacattatgcccagatgaaagtttgctattgacgcattgtt

SEQ ID NO: 1117 - DNA, 121 bp, Gadus morhua
cagacacatttttttgttcagttgaactcccttattataattaaaaagcaaaatggaatgygcctaatcagctgacaatctggactgggaactcgatgcagaacagatgctttgccttcgt

SEQ ID NO: 1118 - DNA, 121 bp, Gadus morhua
gctacatcaaagaaagtcattgcgttacatgtttgtatttaggtttgtgtgtgtgtgtgtwcgtgtgtgtgttcgtgtgtgtgtwtttgggtgcacgcatttgtgtaagcatatcctatcc

SEQ ID NO: 1119 - DNA, 121 bp, Gadus morhua
taatatgtatttacagacatcgtaaccagaaagctttgaaaggatgatacagaattcaacmacaatggacggatgaaataagatctgccgtaacatgaaaacaatgtcagtatgtcagtta

SEQ ID NO: 1120 - DNA, 121 bp, Gadus morhua
ggtacttgtggactgatccaaactgggttttctttgtgcacattgggttaaaaacagcatyaatcaatacacaacttttaaaagacactcacaaaaatagaaagtctccattgtggaacag

SEQ ID NO: 1121 - DNA, 121 bp, Gadus morhua
cacaaattcactttgtcagaggcgcccagactgaaatgtcaatcagttccacacctagccyggtgtctctcaacgtgcactcagaccggccttgtggaacaagataaaacatgcaagacac

SEQ ID NO: 1122 - DNA, 121 bp, Gadus morhua
gaaagaccttaaaatggttgaaaaaagcaacgcttttcttcttgcttacaagctaaggaarggtcagctatcaaccagtgtgtgctggtaccgggatacgataaaatgctacaaccacaaa

SEQ ID NO: 1123 - DNA, 121 bp, Gadus morhua
tgaccgacagacacctgtctcttgatcagagccaggctctctctagccctggtcagaagcyggtccatacttttagggttgtccacatgcttattctccctgaaaccatcctttatccggc

SEQ ID NO: 1124 - DNA, 121 bp, Gadus morhua
acagtacaggtcgtcctacacaggacagacgaaagacctagggctgtggacggggtccatkcctctggtcccctccacaaggctaacacacagaagcttcaaacagcacggctcacatggg

SEQ ID NO: 1125 - DNA, 121 bp, Gadus morhua
cggttctgcatggagcagatctagaacgcgcggttctgcatagagccatgctgcttctgamggcatcactgtatatttggttatgcatattaacattgaataaatcttgcaaagagtttgt

SEQ ID NO: 1126 - DNA, 121 bp, Gadus morhua
ttctgttgcattttcacctagagaccagttagcatgtctgctagcttctgttgctttttcwtctagtggcaagttagtatgtctgttagcttctgctgccttgtcatctggaaaccagtta

SEQ ID NO: 1127 - DNA, 121 bp, Gadus morhua
ggtaaccagataaagagttaagggtaaagctaggtagggtattgtcaggtacagtacggtrccataaggtaaggtagggcatggcggtaaattggcagatggtttggatacatcactggat

SEQ ID NO: 1128 - DNA, 121 bp, Gadus morhua
tgtatcaagacactaaaaaccaaaacaggccttaaaacacaaaaaaaccaaacaggccttytaaacattgactaccattagaccaaaggcagtctccaccgactaggcactgaataatgag

SEQ ID NO: 1129 - DNA, 121 bp, Gadus morhua
aaaaaggtctttgagaaaggccggctttcatgcaaacttacaaacgtcttcctagccttcwtgtatcccccagtggcggaggaccagtcgagataacactctttcatctccatggcaacag

SEQ ID NO: 1130 - DNA, 121 bp, Gadus morhua
gagcgtgtgtacctttaagttttcacaatataacacggcagcacacaagctatacttacakgattagcaatatttactacatcataagatgtccaaaatcagaccgtagatagatacgggt

SEQ ID NO: 1131 - DNA, 121 bp, Gadus morhua
aacacaacagctaactaaacacaacaggttgtgacaaatccttccatgtgtcataaaactyatttatggagtatgctcttaatattccagaacagtaaacaaaagcatcgggggctgaaca

SEQ ID NO: 1132 - DNA, 121 bp, Gadus morhua
acgggagaaaggagctgccttgagtgtttggtccagtggtatgtacccagagttggtcagrcgactgacatttgcaaaaataaaatcaaagaatgtgcagtgtgacaggagtgtgtgtgtg

SEQ ID NO: 1133 - DNA, 121 bp, Gadus morhua
ccccattatacaccagggtttaaaaacgaaaagcagcatttgaaatgtttcaactgtacaytgaattcacccgaaaaagtgacacaacacaaaaactcagtcggcatggcaatcctccaaa

SEQ ID NO: 1134 - DNA, 121 bp, Gadus morhua
caaaacgttcacaatcagatgtcacagcaaacacgcaaagctgaggtaacaacacaggagwgagtcagagagctacggcgtggcatgtgttttaaagttcatcgtgcttgtaggtgaactc

SEQ ID NO: 1135 - DNA, 121 bp, Gadus morhua
agtcccaccataacgcaaaacaggggctactcgaggaaacacgacgggggcttctactccrcctgaaggcccctcccacgctgtaaaactacaaccatggggaggtggatagtggaggagg

SEQ ID NO: 1136 - DNA, 121 bp, Gadus morhua
atttataacgggagtgattatgtaactccaaattcaaatttccacttgaatgttaccaatrtttgacaaagaaaatatatttttgttagcgtatagccaatagatgttgagtaataattac

SEQ ID NO: 1137 - DNA, 121 bp, Gadus morhua
cggagaacataaccggtttgaaaccagttgtggatgaataagactggagctcttctcattktgtggctgtagcagaagactggagatgagttgggataaagggctgcacacaatatgcctg

SEQ ID NO: 1138 - DNA, 121 bp, Gadus morhua
tctgagtgaagagggagcaatagatacagcttcgatcacgcattatccactcgtaaatcakaaagaaacagaagcatgccacacaaagatgaagtagtttgaggatttgagtttcagtaat

SEQ ID NO: 1139 - DNA, 121 bp, Gadus morhua
ctttcacaacaatacacagtataagagtagggtctgtctgctggcagatgacctctgtccrcagcagctctccatccctcttcagcgacaccccgcaggaggcaaacagcagctctgttct

SEQ ID NO: 1140 - DNA, 121 bp, Gadus morhua
tatactggtcccaaattagatcaggtacaggaagtgatgtcagactgcgggccatagtacrggtgtttcttaaggaagtccagaatcttccaccaggaatcttcctgggcgtggcagtgtg

SEQ ID NO: 1141 - DNA, 121 bp, Gadus morhua
aacatccttcggcccaacacttctcttctcttagtgcaatatattgagaaggttgtccgcygtaccatagcgtgagcagtccttgttaaacccagtagttcaggcagtctgaaggtggtgc

SEQ ID NO: 1142 - DNA, 121 bp, Gadus morhua
aatggtcccgcagaaacaatattggcaaaataagcgtctcttgtatgcacatgtattttcratcaggaagaaaatggtctttaggcagcaaggatggaagagaccgggcacatttaccata

SEQ ID NO: 1143 - DNA, 121 bp, Gadus morhua
ccgaatagcacagcgagcctaaactacagccaactgaccatcattccaccattttcaagcrcatcttagtggaaagctggataacaagagtcctagcactgggagagaaagagccacagca

SEQ ID NO: 1144 - DNA, 121 bp, Gadus morhua
ggtttcctcaaggctttggccaactccgaggtagcctcggacagaaaggcagctgggactkcatcctttgctacgttcgtattgaccgtgaacatcggcatgactgcaatgtttgaagggc

SEQ ID NO: 1145 - DNA, 121 bp, Gadus morhua
ctctttatgaaatatcacaatgttcatttagaaggctttaggcaaaatacttggtctcaayttggctcaaacaccacccaaaattaaattaatacatttctttcatgtggcagtcaaacac

SEQ ID NO: 1146 - DNA, 121 bp, Gadus morhua
ggtcagcggtagaaatggtttagctttcctcccccgatgataattcttctacctcatcccsttctccaccgattgccatccaaaacgctttagctaccttttctgcatgaactttcctctg

SEQ ID NO: 1147 - DNA, 121 bp, Gadus morhua
cgtggcgactcccttcacgtcctggagcctgtcggagtcaaagtccaccaggaactccctracccccgccctcatgggtgtgaaggacagctccacagacacacgctggcctggagcgatg

SEQ ID NO: 1148 - DNA, 121 bp, Gadus morhua
gctgaactgagactttcagaatacaattgaaaaacaacatgacttctagccatcaagccgragtatgcaaacatgaatgaggagtactggtttaatttgtcacaaaactgctctgagttgg

SEQ ID NO: 1149 - DNA, 121 bp, Gadus morhua
aacaacgttaacacatggcaattcaatgatacacatgcttggagatttaaaaatgctgtaycgacagcctgcattgaatcagtaacacaaaacaacaaaaacagttgtctgtactgaaaaa

SEQ ID NO: 1150 - DNA, 121 bp, Gadus morhua
acaggatttaaatctagcttgcggatgtaaactgaaggcagcatcaacggaacaagccagkagaggtattacagtgaacttacggtttgtcaagacagtatagaaaacggtacaacgaatg

SEQ ID NO: 1151 - DNA, 121 bp, Gadus morhua
tggacattggtcagcacccctcacttaccatgttaatcgttttaaacattaaactggaatrtggtttcaagtgaaagataatggctgcagtaagaacaaaataaaaaatcaagacatgtta

SEQ ID NO: 1152 - DNA, 121 bp, Gadus morhua
attagagcgttgcagccgaaagcacaggcctacatatcaccaaagcacaggactctttccrttttaaaagcttgctgaaatccaaacttccatttccttttaaaagcaaaacaaaggagaa

SEQ ID NO: 1153 - DNA, 121 bp, Gadus morhua
tgtaggatacatttatgttccaccagtcgttttggtaacagtggaagacaaggatacaatrcaggtctcaggcatggacaacctggtcggcttcagggaagtatcaacttcaaaagttgat

SEQ ID NO: 1154 - DNA, 121 bp, Gadus morhua
ctactatttcttatggctaccgtgaatatgagaatgctgcatccaggcagttacaattttkgatcgagattgcaaagcttagtaacataaggcacttttcaataggtaatctggaaaatgt

SEQ ID NO: 1155 - DNA, 121 bp, Gadus morhua
cgtccttttggaaaagtggtcgaggttgttcccctcatccaagatacgttggtcctgtcgyactatcattgttccatcctgaatttcctttgtacgccgatacagattgctgcatgggggc

SEQ ID NO: 1156 - DNA, 121 bp, Gadus morhua
gttacacaccaagacctgtgatgtcatcaattcaaatatgtgaatctctttatagtgacarratggacagctcttgaatccatttaagtggtgaagttaaatgaaagtaccatctataaag

SEQ ID NO: 1157 - DNA, 121 bp, Gadus morhua
aatcagaaacaatagctttgcagggccatcgctacaacacattgcatgctgggatacattwagatagacttgtaaagcggtctacaaggaagtacaaaatactttcagaactcttaacact

SEQ ID NO: 1158 - DNA, 121 bp, Gadus morhua
tcaaagttaaatgagagttaattcacaaactcaattgtggcttcaaaacacgccaaccgcscctcttacacggaaaaggccaaacgttttccatgttgcagaaaagagagaaggagcataa

SEQ ID NO: 1159 - DNA, 121 bp, Gadus morhua
ctacgttttcatctttacagagggtcagtcctgttctcacctctgcttctccacttcaaayataggaacaggctgaccctgaaggtcaagagtcaaaaccatcgtcaatgaaaaacgggag

SEQ ID NO: 1160 - DNA, 121 bp, Gadus morhua
ttggcgagtgtctttaaaaatagaacagcacaaacagattaaaggtattactgactcatcyacacagttgtgctggaacaaaagcacaaatgtgttccaggcctcttcaaaatataacacc

SEQ ID NO: 1161 - DNA, 121 bp, Gadus morhua
taaatgtattgtactgtgctataaaaacaaaacagtgcttccgtattcaatcactcactaytattcaaatatgcaaaacgttatgaagaaggcagtatagaatcatacaatatataataac

SEQ ID NO: 1162 - DNA, 121 bp, Gadus morhua
ataaccatggataacaaacattagtttcagacttgggtaatactttgtttcggtcaatgcktgttcaaacaaaaaaaggcatccattggtatgttgaccggtagtattacaccaatcaggc

SEQ ID NO: 1163 - DNA, 121 bp, Gadus morhua
taaaattgctgaggtcacgttgctgattagttagaaaattggatacaaccataaatgctcrgcacacattcagtgtaaggctgtaagtggacacgtacaacaaataaaccaattttatgat

SEQ ID NO: 1164 - DNA, 121 bp, Gadus morhua
gacatggttacactccacaacaatacatggaaaccgaggtgttgcatgagtttccgagagkgtctattcagccagtgcataatgcctgaatactaaccatccaggcacagttcccatgttc

SEQ ID NO: 1165 - DNA, 121 bp, Gadus morhua
tcaaaggactgcagccaaaaaccaacacaaatctccatccaatgtgatatatatcttcctkcctgccagaaatcacaaaatgatgtacaaaggcacacattatctrctgccgtgggactaa

SEQ ID NO: 1166 - DNA, 121 bp, Gadus morhua
cccaagtgacaatattaatcattgtatctgtgcatagatcatacgaggcagtaattggtaratgctattgcgactgatggccataaaaggtataacagggcttgtacatcgtgatgaaaca

SEQ ID NO: 1167 - DNA, 121 bp, Gadus morhua
gtaaatccatggcaatttcatactgtccctttgaccgcagttgtgccattgagcactctargggtaaaaccatttcctgtatttaccctggtgtattcatcatcagaatcatcagaacttt

SEQ ID NO: 1168 - DNA, 121 bp, Gadus morhua
cgattgactagcttcggttttaacatttgaagattagaagtattttgtgacaggacttttytttattttttatcttccccacgttgaggaaaaaccttaaagctgaatttcacaaatcatc

SEQ ID NO: 1169 - DNA, 121 bp, Gadus morhua
tagcaacactgttagtgtgtacacatgtatacacactgaaggcctctttgttttattattktccacagtagaggttacaattttgaacagcaggtgagaataggagcaattgacgaataac

SEQ ID NO: 1170 - DNA, 121 bp, Gadus morhua
tcttcgcacgacattgtccaaacaaacataaatattaatacaggtttggttgtcagagcgrgggttgactggctgatcaggggggtctgggtcatctcgctccaaccagaccatgccgttt

SEQ ID NO: 1171 - DNA, 121 bp, Gadus morhua
ggctgacaaagactcacagaacactcaggaaagacaaccattatcacagtcttcacgatgyacagaattagtggatgatttgtgttcaaagtcttttttttgtagtgggacaagcttttct

SEQ ID NO: 1172 - DNA, 121 bp, Gadus morhua
tagaaagtagtaacaacaaacgcaaacccaaatcagtctacgtaattaaaagactgagatwatgatttgaactcaatgtggcggttaaagattcataatcattcattcattggcatcatga

SEQ ID NO: 1173 - DNA, 121 bp, Gadus morhua
catccattaacatacctacacgtaggtgtatgcatcaggtacgggtgattttacatgtatktatgcgctttgggttattatagcgtggtaactttacgacgacatcaatgcaggtgattaa

SEQ ID NO: 1174 - DNA, 121 bp, Gadus morhua
caaacctcgtttgctgtggttggaatgaatacatccatgggttaaaactttgcaaagcttratcattgaatttgacattctctacccacttggatattttaccataagcaagaaaatgaac

SEQ ID NO: 1175 - DNA, 121 bp, Gadus morhua
cgaaaaaataaagaaataatagggacacttatgaatgacattccagaagaatttataaaakggacaccgaaattggctcatcacaatcagggaaggaccaaacaacataattaaatgtagt

SEQ ID NO: 1176 - DNA, 121 bp, Gadus morhua
agagtaataacattgaaaacagcagcattaaaacacttgtcaataggccaggctgctaagmtgtgatacaaaggagatgaatgccagcctttgacacatccccatactttaatgcgtttta

SEQ ID NO: 1177 - DNA, 121 bp, Gadus morhua
cgatttcactataggcattaaaaatagctaaagcacgatgaaccacttttaaattaaaatwagagaagcctaaccctaacccttttttcccaacagcttggggctcccttcatactaggtc

SEQ ID NO: 1178 - DNA, 121 bp, Gadus morhua
ctcttcagttatgtgtaaacagtaaggcacaacacacacacatcaaatatgtgaaaaacawgaaatcaattgtgtcaaagggaaaaaaacactgtgcaaattacaaatcaatacaggttaa

SEQ ID NO: 1179 - DNA, 121 bp, Gadus morhua
gcattgattaattgatgcagttctgtcgattcgccgccctactccaaacacatacaaagcrcgtcaaggtttcaaaagtccaacgcatccamtcgcagtctgaggagcccctttctgtccc

SEQ ID NO: 1180 - DNA, 121 bp, Gadus morhua
ttgaattaatagatcaagctaaatgactcaggaaggtactgaatgtttttttttacatttwaaacaaaagggatcacaggagaagtctcaatgcagcgacgatgaatcggaagagaaaccg

SEQ ID NO: 1181 - DNA, 121 bp, Gadus morhua
gttattgaacagttccaactgttaaatcaaaaacagatgctaaaaatgctcacctaggagratatcactgatttaaaggaacatttcagggccctgtgtaaagcatgaatacaccattgaa

SEQ ID NO: 1182 - DNA, 121 bp, Gadus morhua
tcgaatatatcattgtaaacatcaatattatgttcttgaattaattcggcaaataaatcargccatttgaggtatcaactttcaaagttcttgggggataagagaatataaggatgaggca

SEQ ID NO: 1183 - DNA, 121 bp, Gadus morhua
gaggtgtgttcaggtggagggtgagctgtaaaccaacatcagggaaaagggcagcgawgtktcttgcggtgttggagccaggcattcatggaggcttttacaaagcaggcctccctgtgct

SEQ ID NO: 1184 - DNA, 121 bp, Gadus morhua
agttcatggagtacagtaatgcccacttttatacatagctctgaggtcagacagcagttcracctttcatctttgatatgcttacattaaaaaaagatcacagtccttacagtttcaaata

SEQ ID NO: 1185 - DNA, 121 bp, Gadus morhua
ttagacaatttcacaaaaataacatccattcaatcttcactcaaaatctacaaaaatgacytcttagccattgacacattcgtcagtacaaaaatggaatctaaatctggaattgttgaca

SEQ ID NO: 1186 - DNA, 121 bp, Gadus morhua
tctttgtaatcttcttatctcctatattatatcagacatgacataggtataacagacatgkaacactatacagattgtatacacattgtatgcatctttaaataaagacagcttgagttat

SEQ ID NO: 1187 - DNA, 121 bp, Gadus morhua
cctgaagaacaggttcctgtgcctgatgaacacctcctgtatgaagtcacaagagtctctkcctccaggaagccaacgtgcatagaagtctgatcgtgtttcagacctgaagcccactgaa

SEQ ID NO: 1188 - DNA, 121 bp, Gadus morhua
cctctaaaacaataattttcagcaccagctctattgctttaatcacacatgtagacaccargggtttttaacaaaaatacacagcaggggagatcacattgcatgtatacaagcgcacaca

SEQ ID NO: 1189 - DNA, 121 bp, Gadus morhua
catattctacaatccaccaggctcagaaagtgttaaaacattttaaacaatttaaaatccytaaaaggtttttaaagtttttcgggcattccatctaaataaccttaatccgtacttcctg

SEQ ID NO: 1190 - DNA, 121 bp, Gadus morhua
tacattattcataagtcttcacacagtggagatttgagttcatccgataggttgcattgaytttagtgacattcttgtatggctttgttaaccatgaccgcmaattcaaacggtagtcatt

SEQ ID NO: 1191 - DNA, 121 bp, Gadus morhua
acacatccaatacaattattgtttattttactacccgtttgttgcgttttcttttaaaggycaccgccatggtggcgtacaggacagtgccgcgtgaccactcaactcagagaagaatcat

SEQ ID NO: 1192 - DNA, 121 bp, Gadus morhua
atttaccttcttaacatcaatagaaaaaaaaaaaaaaggtaaacagcctaaacaggattaratttgcaaaatcaccaccgctttatttattttctttaagtaacgtcttctttttaaacaa

SEQ ID NO: 1193 - DNA, 121 bp, Gadus morhua
atctatatacatgtagcttaaatctatacgaatagttccaaaatctattcaagcaccatgrcctccttgaatgagtcaatccatctctgggctgctggggcgtcgtctgccttgaagatgt

SEQ ID NO: 1194 - DNA, 121 bp, Gadus morhua
acattgccaggggtttacgggggtttgtttccccacctgcagccaccccatgctagcaatrcacagtgtttatttgaagacactggatacaagcgttgagtgtgatccgcgtgacacatga

SEQ ID NO: 1195 - DNA, 121 bp, Gadus morhua
attttctacctagaagatgaatggcaaactgaacccccagcaacaccactcaacaagtgcrccgtaactcaacagtcctagtttttacgttcctactttctggaaatattgttccaaataa

SEQ ID NO: 1196 - DNA, 121 bp, Gadus morhua
aaaggatttgtataaaagtataatttcttccgatagttacatctaataaagggactccacrctccatgtctgtgtacgaaagcttggtgcactcaggggccgacaggatacatacgggggt

SEQ ID NO: 1197 - DNA, 121 bp, Gadus morhua
aacagatgatgacaaaccattgatcggcataaaccattaaatggaacctagtccacatcamcacgttgaggttttgaactccgtctgcgtaacaatacaatttacaagacaaatcccgagc

SEQ ID NO: 1198 - DNA, 121 bp, Gadus morhua
tacatctaatctttatttcttaactacattttgtatttacacatggtcgaacagatgatamcaaaccattgatccggcataaaccatttgaatggaacctagtccacatccaaccaccgtt

SEQ ID NO: 1199 - DNA, 121 bp, Gadus morhua
tttatacacatacaaagaaagattgtccttcgaaaagtgcagtttccctcccccaaagttyaagataaattccttttttaaaagatgaccagaggaagactttttaaaaaaagtatgcacc

SEQ ID NO: 1200 - DNA, 121 bp, Gadus morhua
ttggcatcatggttgtgttttcccttttgcgccatagttcggctgaaacatctaattccgrtatgtttaaagttaactttgtacgttcatccgttaaaaaaaaaattacatcacatcaaaa

SEQ ID NO: 1201 - DNA, 121 bp, Gadus morhua
aaaacattgctattctaaatccctttcttgattaaaatcagttttatacacgttgtcctakttattaatgcacaatcaaaaaaagaccatgcttaaagaataaagtggcactttttcattc

SEQ ID NO: 1202 - DNA, 121 bp, Gadus morhua
aaaatcttacaagccttataaggttacataacataattcattgactacaaaacatacattyttagtatatgcacacaaggagttcaaggtacagctctcaaggtgttcagtgtctctgaac

SEQ ID NO: 1203 - DNA, 121 bp, Gadus morhua
acagcattatagaagcaatctgcaaactatgagccacagtcgccattttgagattcaaccyagaaaacaagcttttatccaacatccaatatgccaagaacgttgatrtaagcaaacaaag

SEQ ID NO: 1204 - DNA, 121 bp, Gadus morhua
aatttgagttacaaatggattgtccattttctattccttggttaaaattggtttgcctatrtaacaaacaaaacatgacatttatttcgaacaaaagaaaaatccataccacattgtatta

SEQ ID NO: 1205 - DNA, 121 bp, Gadus morhua
aacaataygggtgttgttttggcgatccgtgccgcccggtttttccttctgctgagttatwatgactcaattacttactcaacacaactaaacgtgaaatacaaatccgtaagtaaccgtt

SEQ ID NO: 1206 - DNA, 121 bp, Gadus morhua
ttttataaaaagggggaggagatggtttggttgggggggggggggtaatgtaatgtactgstagagctctgtaatgctctacagaacgaaaggccagatgggagaagcggagaggtgggta

SEQ ID NO: 1207 - DNA, 121 bp, Gadus morhua
tagggggaggtcaaactgctgaccgtacatccagtacatgtaagggaagagcagtattcgrcaggcaaagaaactgcagagaaccatgaccccattgatccagtggagcttgctgttgctc

SEQ ID NO: 1208 - DNA, 121 bp, Gadus morhua
gaacatcacaccagatattaaaactgataacgtgtgtcgctgttgatctcgtccaaataarggttttgtaattcttaaagccagcggtgaaacatggaggttttagaagtgataaacccga

SEQ ID NO: 1209 - DNA, 121 bp, Gadus morhua
agcaaatcactttgccattctgaccatagacttccattttaaaactgaaaggcaagaattmattctttatgaaataaccccagggcctgaactttaaaagaatgttacacctggcaattta

SEQ ID NO: 1210 - DNA, 121 bp, Gadus morhua
ctcaaggcagcaggagcacatgagagcttacacactggttcaaccagcaaacccaggcttygagctggcatcataatttttttgtcttgcttctgtctgcacatacagtagagatctgatt

SEQ ID NO: 1211 - DNA, 121 bp, Gadus morhua
tatagcccgcgaaacagagaaactgatgggaaaatgctccaaacacagatggatgcatgtktttctttactctatgtggcgtgttgagccaagcaacatccttattctctgcagtagcgcc

SEQ ID NO: 1212 - DNA, 121 bp, Gadus morhua
attatactatttaggatatatgcctcagtttccaatttaatactgcactacattaatctargttaccatattcaagcattttttgtaacatcctacctttgctcttcttgcaattggcaag

SEQ ID NO: 1213 - DNA, 121 bp, Gadus morhua
agtgccttgacactacagtcataacaagtctttccttacgtattccctctatgaagattcragctgcaagctgttcacactgccagggttgtgtattcaattgtccgactgggtcgtcttg

SEQ ID NO: 1214 - DNA, 121 bp, Gadus morhua
ccactggtgctgttacagtaggagggcgatcgttttcacacacaggataacatcagaaccmttagaaaccaccacgggggaagataaagcctgggacggattcccaccgaatacctgggag

SEQ ID NO: 1215 - DNA, 121 bp, Gadus morhua
acggccaattgcgctttaaagtctaaattaattgaatttacaaacatcacaagcagtggcrtgctttggatggattcgctcaaaacacggccttactttggaagaacacacacttaattca

SEQ ID NO: 1216 - DNA, 121 bp, Gadus morhua
ccacaaacagcagtcttttccatgttgcgtctttgcacatatataaattgtagactgtatwagaacccatttagatgttccgatgtccttgtctatgtgaacagattaaaaaaacaacaac

SEQ ID NO: 1217 - DNA, 121 bp, Gadus morhua
tctgaaactgttgtatctccttccgctttctgcaaggaaatgggactaagtgaaatgtctktcaggcaagtcaaacaccgacctgtatatttaaagcagaacatctggtattttacaaaac

SEQ ID NO: 1218 - DNA, 121 bp, Gadus morhua
gaccaatagattcacaacgggctccgtctgatggctaacaacgagccacagagtagccctwgggctacttacttataagcctacatttgatcataaaggtagtaggggcagccatgccatt

SEQ ID NO: 1219 - DNA, 121 bp, Gadus morhua
taaaaaaacagtttgtaccaagttcaagcataattatcgtaattggtgcaaacctctttcrctaacaaatatggtaggcctatttaattgtgtttgtggaaaactgtatccctgggatgtg

SEQ ID NO: 1220 - DNA, 121 bp, Gadus morhua
tctgggcatatgtttttattaaaaacaatgtggaacagaacgagacatgtagttgcaagayattggtttgcggttgcaaatgagtgcattgtaatacaatgcccaggttcctggccgtgcc

SEQ ID NO: 1221 - DNA, 121 bp, Gadus morhua
gttccttggaagacatagcgaccatcagcagcagaaagagtactgtcaccctagccttacrccaccctgggactgtattmgactaagataaatctagcatcacccaggctagagccaagag

SEQ ID NO: 1222 - DNA, 121 bp, Gadus morhua
gcaagaggggggtgaacaaaatggccacttgcctctgcctgttcggtacatcaacgtccasaccttcatgactgttctacacccatctcaagaatcttctacatacacttttggtcacgtt

SEQ ID NO: 1223 - DNA, 121 bp, Gadus morhua
aaggaattgcattgcagatcatttctaatttattcatttataaatcgctgacaagaaaatygaacagacgtccctccaaggcattctctgccagatgttaaccaacactttattctcgggc

SEQ ID NO: 1224 - DNA, 121 bp, Gadus morhua
agacacgctctcgtagaccaatggtttgacagctagaagctcttcgactgggtcgttggaracctgactgaagattggccagaraaggcttttacccttcttttcatgacgcattatgatc

SEQ ID NO: 1225 - DNA, 121 bp, Gadus morhua
aagacaccgacaccggaacaatattggtagccacrtgtgtaattaaagggatgggggacarcagggcgtttacatagcgaacagaatgaggaaagcgaccatcaaacagaagagacccatg

SEQ ID NO: 1226 - DNA, 121 bp, Gadus morhua
agacaagggcggtgtcaaaatattgtaactacatttccaataaatcaaccaaaagtgacckgggctttctcttccactcacaagcattttaacatttagacgcttaacctttgatgccatg

SEQ ID NO: 1227 - DNA, 121 bp, Gadus morhua
agacaaaatggtgcgcggtggtcggccaccacgttgaagaccctcatggggtcctcagaaraaccagtccaagtctctctcctccccccccccctaaccctaacctcacacctgaccgccg

SEQ ID NO: 1228 - DNA, 121 bp, Gadus morhua
atggaaatttctgaagaaaaaagaaagaattgtacatgacatcactactgaagttaagatyatcactgagccaaaggcaacttgcattattcgtggttcaaattaacacaattgggatttc

SEQ ID NO: 1229 - DNA, 121 bp, Gadus morhua
tatcggaaaaggcgacagctgcctccttgattcagcccatctctggcattaaattgtcatrctacatacaaagagcagagtgtctgcatttgtaatgctaatcctgcygcttgttgccaca

SEQ ID NO: 1230 - DNA, 121 bp, Gadus morhua
ggactcatgtttcaaactgggacgcctaattccttcttcatggctgttatttccatgatgratgccagccaggagaggtttacttcagccaggatctttaccacaccacaacctgacctca

SEQ ID NO: 1231 - DNA, 121 bp, Gadus morhua
cattagtccacacatgctgaagatcatgccaagcaggttcatatagtcaggggtggggtcytccagtgtaggattggctatctgtgctgggcggtttgtaccgcaaaatcttattttgtcg

SEQ ID NO: 1232 - DNA, 121 bp, Gadus morhua
atyactttatgttgaggaccaagataattgctcaatcaacctgttccacttggccaaagcygaaaacattcgtcaacacagtttccatgctattctgggtactcaaacmaaactctaaatt

SEQ ID NO: 1233 - DNA, 121 bp, Gadus morhua
aaacaaactaaataaaacaaaaaaaaggaaatttacacttttacacttattaaaacccagsctttgttgttcaaatcgaaaggtgaacaagaaattaaacggggaaagatgaagggtttcc

SEQ ID NO: 1234 - DNA, 121 bp, Gadus morhua
acaacaacatagttacacccccaaggttgatgcaatgacacattgtccatgcaatgttcargtatataaaaaagtacaaattgacatcacagctaccagatgcgggagcatgcrtatattc

SEQ ID NO: 1235 - DNA, 121 bp, Gadus morhua
agagatagaaacaatagctggatcaattgagtccatccagggttgaatctttgatttcttytcttgtttgtttttgctgtgtacagctggaccacaaataggagccaaatcattcaggtat

SEQ ID NO: 1236 - DNA, 121 bp, Gadus morhua
tgtgtgtgtgtgtgtgtgtgtgtgtgtgtgtgtgtgtgtgtgtgtgtgtgtgtgtgtgtgwgtgtgtatgtgtgtgtgcacctgcttgcaacaccactgtttataataagtatgcaactat

SEQ ID NO: 1237 - DNA, 121 bp, Gadus morhua
tggtcaagaaaaataaaattagcttatcaggcctatgatccggatggcgtgggagtgtccrtgggcacgcttcattgacctagacccaggcacgcctggatatcttcatatgaacccaaag

SEQ ID NO: 1238 - DNA, 121 bp, Gadus morhua
tcctctgttcatcaagtctacaatttaaattggtccacttttgttaacatggctgttgcaytttaatagactgagaaatggtgacaagaagtgacccgtgtgactggtagttgacaaatca

SEQ ID NO: 1239 - DNA, 121 bp, Gadus morhua
ttcattaactcgggataccarccattgcatattatgtacaatacaaaggaaggaaatgaarggacaaatatgtgcattgttattccgtcgggtacgctgtacaaaactattgcggtgagag

SEQ ID NO: 1240 - DNA, 121 bp, Gadus morhua
aacagttaaaaacatgtataaaattggtcctgtttcagtaacaaggcacacacagtcatgwcatatgttcataagttcatcggcatgtataatattatatctttcgggggcattccaactc

SEQ ID NO: 1241 - DNA, 121 bp, Gadus morhua
tacatctaaccaggtctggtcttgttggacatgattatggacttaagttaattgcttaagrtcagccttctgaattcaccttgtgccatcagttaaagatattttccaaaggattgtgaaa

SEQ ID NO: 1242 - DNA, 121 bp, Gadus morhua
cttttcatgctcataaaaggttgtaatgtatatgatggatccccacgtactcatccatcascccctgtatatccccattcagtagatgacatgctagtggttttctagaagataacaaaag

SEQ ID NO: 1243 - DNA, 121 bp, Gadus morhua
gtgttgacctcaacaacataatcaagtcggtatgaatccacaaccacaagtcattgaatcrtagggtgataattacaggtcttgagagtccatttcacaaatccatttgagcggatgcgta

SEQ ID NO: 1244 - DNA, 121 bp, Gadus morhua
ggtcttgttttaaaggtgctcagagtaggcctattttatatgtatagcgtccttcgctggrcaggatgtagactgctagcattacgtacctgactgtcaggcctgcaaatgaaatagaaac

SEQ ID NO: 1245 - DNA, 121 bp, Gadus morhua
gttgaaccgtagcaagtactttagtaaaatagtttagctcatgtcaatgcaatagatcaawtacaatttaaattgcacacatgataggtctcattaattgaccagaataaagaaataaagg

SEQ ID NO: 1246 - DNA, 121 bp, Gadus morhua
cgccaacatacacacatggatagtggtttgattcagtattagttccaaaggtgggacgtcrcagcaggtacagtttattttaattacaaaacagcccacacattaagtttttttagtttta

SEQ ID NO: 1247 - DNA, 121 bp, Gadus morhua
atattttgatatttttgtacgtatcctatcatgtcctaagatgcaattcaaattctaaacrtaagaacagatgagccaattacatgaaagaaacattaagcacttaatcgtccgtcaacat

SEQ ID NO: 1248 - DNA, 121 bp, Gadus morhua
taaaactattccacatgcaacaaaggcaagacgagtgcatcaatttttcatctttgtaccyaagaccgatcgatgatgggaaacgaatgtttcaactttacaaaatatacacaagtgtcgc

SEQ ID NO: 1249 - DNA, 121 bp, Gadus morhua
gtgtttaattaatgacattaacttatgcattttcatcagcaaaatcctcaaagcaatccaygtttgcaattacgcctgcttgcatcaacccctttgctgcttgacattgaatgtgtctgtg

SEQ ID NO: 1250 - DNA, 121 bp, Gadus morhua
aagttatattttccttcctcaggaaaacaactttttttttttttttacaaaaatgttgatwgccagtgtacaagcggttggcggttcccatggtaacccttgcccagtacaagctgtttgg

SEQ ID NO: 1251 - DNA, 121 bp, Gadus morhua
cagaaataaatgaggccttcatataaccgttacatttggaaatggctgcatgggcacttaytacaaagaacagactttggaagtaacacagtaaaatacctacgtctgatcatacatgtct

SEQ ID NO: 1252 - DNA, 121 bp, Gadus morhua
tttatttaactaaagtacagtactttacaataacaaaagttttatctcttcgaatgacttytaacataaggtgaggggagaacaagaagactttacaaaagcccagaagaaatagttcata

SEQ ID NO: 1253 - DNA, 121 bp, Gadus morhua
ttctaacatacttccaaaaaacctccatacgtgaagacagaatagcccccattataaaatsattcgatacacaagcatccagttggaaatctacttccagctgaagaagaaagtacaaact

SEQ ID NO: 1254 - DNA, 121 bp, Gadus morhua
tttgggagataacagataagaatgaatggagaaccacggcaccgtgttttctatcatgacrgcagaaaaacaagaaataaagccataatgatgagaaaaatagtgcagtaattcccgtagc

SEQ ID NO: 1255 - DNA, 121 bp, Gadus morhua
gaattatacaggcaaacatggtagatacagacagcataatgacattcattgataattattratggacaatttataaagcaaagtaataattatgaaaagataatttgatggacagtattat

SEQ ID NO: 1256 - DNA, 121 bp, Gadus morhua
atccctcgtcccgatgttcaataatttaaaacattcaaagacttgtctatatttgataaawgcctgaactcatgatatctaagaatacaataccatcaaaagtgcagaatggtgaagtaaa

SEQ ID NO: 1257 - DNA, 121 bp, Gadus morhua
cgagagaaggagcactgtatgtgcacaccgtgaagcggtttgtgatgtaagcagcacaggygcttatgttttcagacgagataacatgaggcaacacgttccgttctgttattcaacagta

SEQ ID NO: 1258 - DNA, 121 bp, Gadus morhua
aaggccttcgtggcatcattgtaattctgcagctcctttgaacagttctggtggtagctgyccccctccctctgcgtgcaagccctcatgcgctcctggaggatacggaccaattccccct

SEQ ID NO: 1259 - DNA, 121 bp, Gadus morhua
gtgctttattcactccacaaagtgccagttcagcctggaagccctctgtcacaagaatccktgaaattacaaagtaggcctttatactgtagtctagcctagtagaaaawtaagaccggga

SEQ ID NO: 1260 - DNA, 121 bp, Gadus morhua
agtgcgtgggggtacaataaggggcactggaaggtcccgcccctggacttcctgtctgcartacaaggttctttgaatgttgatggttctgtagggacaagcatgtgcagtaggcctgctc

SEQ ID NO: 1261 - DNA, 121 bp, Gadus morhua
ctggtttacctttgtctagtaccttcctgtgttgcttttgactgcatagaggttctttttkgttttcttcagccttggactttcctgctgaattacctctttgggcgtgttcaccggttag

SEQ ID NO: 1262 - DNA, 121 bp, Gadus morhua
agcacattcagcactccagatggctttactctgatgtatcaagatgtggagtttgggggtmagttcttcacattgacgtctatagaagatgtgcaagacatgggtaccctgaaagttgtcc

SEQ ID NO: 1263 - DNA, 121 bp, Gadus morhua
aaaatagaaggcaacttccaacatttcaataaccggatgagcaactcggtccagtttcagyagagtgacttttgctgtttattagagtgacagcaattgcatttgcaattcaggtcttata

SEQ ID NO: 1264 - DNA, 121 bp, Gadus morhua
acacgtttccatatccgcaaattaaaaaacaagcaaaacaatttttttaaaacaaccgccyactcctctttccaagccaaaaaaaaaaaatggcagagaaacgacctttattgtccccttc

SEQ ID NO: 1265 - DNA, 121 bp, Gadus morhua
tacacccgcatttgtttgcctacagacaatctctaacacatgtaaatttctggacggcaarccacaaaacgtacragccaaaagacgtttactgtttaaaaaagtatgatcaatatctttg

SEQ ID NO: 1266 - DNA, 121 bp, Gadus morhua
tctgaagacccggaggtggacgtggtcctctcctcccacatggaccttgatgaagaagttkgttccagccaccacctgggttttgtaagtctttgccatgaagacctcataagacttgttc

SEQ ID NO: 1267 - DNA, 121 bp, Gadus morhua
atgaacaaggtttttgtctcatttcctacaaaacaaattgaaataaatggtcatctacatyaatcccacctggataacatttttccaaatagcataccatattaatgtaaaaacgtcaaaa

SEQ ID NO: 1268 - DNA, 121 bp, Gadus morhua
aaaagatttgtagagtgaatctccgtatgtacaacatattgcactacattaaaaaaaaaawaagtcattacttccatcgtatataaacacacagaaaaactcacacaaaaagagtgcacag

SEQ ID NO: 1269 - DNA, 121 bp, Gadus morhua
ataaaaacaaccaacttatggtatgctctgacaaaacctgaaccacccgtacaaaaacagrcccccttttaataagaaaatacaatttaaagtttaaaaagaaccatgaataagaaatggt

SEQ ID NO: 1270 - DNA, 121 bp, Gadus morhua
cattgatccttgatcctacttatccatcataaaactcgattctcatacaaactattcgatkaatataaacttttatcaatggtgctatatacatggcagccctataggggtcactacacaa

SEQ ID NO: 1271 - DNA, 121 bp, Gadus morhua
caaacaaccgatttgcgattgttcccttaatatttgcataagactaaaaaaacaaatttcrctgacctaaaagtctcacgtttatttttgggcttccttttttttccctgtacctcggaag

SEQ ID NO: 1272 - DNA, 121 bp, Gadus morhua
gaatttaaggcacattaaatagttaaaaaaccattcagatgagcaattgcggattgtttcrctctgctacactgaatatgttgacatgcattagtaaaaaatatgtacttgaaaatgcaca

SEQ ID NO: 1273 - DNA, 121 bp, Gadus morhua
tatagttctgtcgtggatggcgggccatcactgatggaagaatacgtagtggagaactcgktgtaggtggaggactttggtcagtttggctggtgtgtaaggctgctgcaactctggctca

SEQ ID NO: 1274 - DNA, 121 bp, Gadus morhua
tgcatctcgaagtggtatgtagcagtacaatagcagggtcaaaacggtgaatgcgggagasaatacagtatttgattacatttgcgcttgtgttagtgaaaaactcaacatggcaaccgga

SEQ ID NO: 1275 - DNA, 121 bp, Gadus morhua
caggttaacgattctattaaaagcaatatagtaacgacgttttaaaagagcgatttcacawcatccttcaaggtctgtagcccatagaagctagaggcgtgacttaaccgataaaagaaat

SEQ ID NO: 1276 - DNA, 121 bp, Gadus morhua
tccctctctgtatccaacccttattcacaccaatgccatcwtcctgccaaaaccggygatmtgtaaacatgtggttggtgttcagcctctacactgtagaccacagaaaggattagcacct

SEQ ID NO: 1277 - DNA, 121 bp, Gadus morhua
tctttacgttcaacacatttcgaatgacttcggtttttcaatgaacatgttgtcaaaactsattttacaccttagagaaaagattccccaaaatgtcccattgttgcaaaaaagaaagcaa

SEQ ID NO: 1278 - DNA, 121 bp, Gadus morhua
ggatctttctcagtgcagatagaatcagcatatccacttcatccttcaacttcgatttctscatggtagttcttcaggggaaagatgcagttcagtgggaatcccacggtattactgagct

SEQ ID NO: 1279 - DNA, 121 bp, Gadus morhua
caacagggttatctgaggaagacgaagggaggggaagggcgaggtcttggcgcactctctrgtgaccgcgcacgctctggagacagtgcacgctccgtggtcaggttcagtacacatggcg

SEQ ID NO: 1280 - DNA, 121 bp, Gadus morhua
tgtcaatatgtgcgaaataattactacgattattaaaaccatcgtgtttacttttggattytttatggcaaaagctttaggctttagcagtgtggtgtggggtctctatacacggttaccc

SEQ ID NO: 1281 - DNA, 121 bp, Gadus morhua
ctcattctcaaaacaccaagatgaaataccacctgcatcgacgcaatcrtcatctatctcragaaaggtaaacatacctacagtatgtgctcggtttcactttcttcaacaaagcaaaaat

SEQ ID NO: 1282 - DNA, 121 bp, Gadus morhua
tctttatttcttagcaaacaattgttatggttgatttgtgacaaawcggaggactcctttyaacccgattcaataaacatgtgaggacttaatctggatacagttgcatgttcgtccagta

SEQ ID NO: 1283 - DNA, 121 bp, Gadus morhua
gtctatgggaataattcatcgatacatatatggttcatattaagataataactttaaatawttttttattacttggacgcttacgttataagtctaaatgcaatcatgattataagatata

SEQ ID NO: 1284 - DNA, 121 bp, Gadus morhua
ccagcccttggtaattagttcatacattacaaaaatagggtagaacatggagggaggcacyagactsaggcactagacggaagaccagttaataggtacgaaacataaaaacttaattcac

SEQ ID NO: 1285 - DNA, 121 bp, Gadus morhua
cacaatatgcttttggactcaagatggtaattcaagtgaacatttatttactatttttttwtattaaaacgtggtctatacaccagagtttgtcccagaatgctacgaaagtcacgagcag

SEQ ID NO: 1286 - DNA, 121 bp, Gadus morhua
ttttatcagagtctttgattgggaatgagatacaaaggaggtcccgggggacggggggaamatcgtgcatcctacaatccttaacagggacaagactgcgggccgcaaggacaagagcatc

SEQ ID NO: 1287 - DNA, 121 bp, Gadus morhua
catggtaaggaaaagtattaaagcctttattgtattgtgtacaaacaaacgtaaaaaaaamattaattaattattctttgaaaaaatatccgttaaacaaattcatgaaaatggaaataca

SEQ ID NO: 1288 - DNA, 121 bp, Gadus morhua
aaaatgcccaaatgaacagtgtacaatagcattcaatataaatcatggtaacctaaaatgsatcttttttggggctgtctgtatttgacgctctgaccccactgtaaaagattttttagca

SEQ ID NO: 1289 - DNA, 121 bp, Gadus morhua
acaagtagatggtctttgcatgtacattcataatataaacttactgcctgccttccacctwttccccttcttgtgcaattgtgtaatttgtgatttatcccaattcctgtagcctttaaag

SEQ ID NO: 1290 - DNA, 121 bp, Gadus morhua
gactccctttacttctgtaaaaaaaacacccctattttgaacccattgtttattcaaactwaaacgtatattatgcaactttcatagcgtaaaatgctccacacacgaagtgcccagcatg

SEQ ID NO: 1291 - DNA, 121 bp, Gadus morhua
tttaaatcttaaaacgcacagtacaaaaaggaaaaaaaatacagacgaaataaacccattktacaattctgtccatcagtacttaactctgcatcgttccatacagtatgtgagcagacag

SEQ ID NO: 1292 - DNA, 121 bp, Gadus morhua
aactgccttcgtcgaccctctccagatttagagcactcaaatgtttgcattaaaataagtmtttttratataacactgagcatctggttattgttcagtttaacattattaatgttattat

SEQ ID NO: 1293 - DNA, 121 bp, Gadus morhua
ccccgccagggtgcgggagtactcagccagccgcagtgccagctcgatctctggggcaccrcctccagcgatcagcggctcttttcttgaccaggcagcggatcacacacagggcgtcgtg

SEQ ID NO: 1294 - DNA, 121 bp, Gadus morhua
gtttgagaacatagaactccgtttgacctagtgcacacgcaaacataaaaactgagtttcwgagtttttataaataatcgtttcccatgataaaaactctgttttcgtgtagcctaaatga

SEQ ID NO: 1295 - DNA, 121 bp, Gadus morhua
ttaatgtatacacttcaccaatgctttacttacagatcggttgcgagcaaacgttttgtgrgtctcgctactgagccatcatcaatatcccataatccacatggtcatcgatccatacagt

SEQ ID NO: 1296 - DNA, 121 bp, Gadus morhua
taaacagtgtgtagctggaccattttgtcctctttttaaagctactgtaggtaagtcatgmgaggtgtaaagagagagagcatgagagagcaagagagtaggattttgaaaataaaccaga

SEQ ID NO: 1297 - DNA, 121 bp, Gadus morhua
gtagtgcaagatacaacttttggccagaaacggagggagaagtcagaggaacgamagaatracatacaaacttaaatgtgggattttaggtctttgcaaagccattcaccagtggggggtt

SEQ ID NO: 1298 - DNA, 121 bp, Gadus morhua
ctattcatattgaaaacccatacaccaaaaaaaaagttgtgaagaacgtcacgtattaatwttctacgtggtaaatgcaaaaaaaaccttcggataaggttataattaaagccagttgcac

SEQ ID NO: 1299 - DNA, 121 bp, Gadus morhua
tgctgccattgcttgcttgccaaaggtacgatagagtgctgtggctcacaacaacttttckctgggtctgatcaatttttgcagtacaccatcttggtccggacagcgtcaataacgaagg

SEQ ID NO: 1300 - DNA, 121 bp, Gadus morhua
atgttttaaatgaaagaaaaccaaacatatttactatatatatacacacgctaatgtgacwtcggcgtttcgtgcaggacaacctgcagctttggctgacaagtggacatgttacacaggg

SEQ ID NO: 1301 - DNA, 121 bp, Gadus morhua
aggacaacataatcgatatttccagttcgaataattatacggtgtaaggaatcgtacgacraattgaatgacataaaaacaagttatctaccactcgcccaagatggcttaatgggaataa

SEQ ID NO: 1302 - DNA, 121 bp, Gadus morhua
tatctaccactcgcccaagatggcttaatgggaataagtcagtttacattttggaccaggragaggcttctagctctcaccacaaacacacacactaattggccatctcaggtgtcaatca

SEQ ID NO: 1303 - DNA, 121 bp, Gadus morhua
caggatctcatcgtagagccagctctgggtgaactcctgactcttttccatcagctggaasagtctcaggtaytcctctggaaacacgttcccagtcaagaatgtcctcaggcaggcccat

SEQ ID NO: 1304 - DNA, 121 bp, Gadus morhua
gggatattctgtttattgatgaaaataatcaaattcacgagaacaattgacagtagctttsgtatatattttcacatttggaggacaatgtttgatttgtaacattttaaaaaatggcctt

SEQ ID NO: 1305 - DNA, 121 bp, Gadus morhua
cacgacgccactgatctctaaagatacaactccacagatataaccgggagccccccccccyycctycaattttaatatcygagttcctggtgttgttaaaaacctgttagctgccgaaata

SEQ ID NO: 1306 - DNA, 121 bp, Gadus morhua
cttttctggcgaaaacattgttgatgtcgcagactgcccttttgagctcacaaaacccctrtgaggccgtaccgtcttacattagaagatagagggagggatggcgcccctttgatattcg

SEQ ID NO: 1307 - DNA, 121 bp, Gadus morhua
aaaaaatacatcattttaatctcagcaacatatacattacataaaaatggtacttttacaracactaattttgaccataccataaaataaaaaaaccatgggtggaacaaaggggcccatt

SEQ ID NO: 1308 - DNA, 121 bp, Gadus morhua
ggtcaaaaagtagagctgtcaggtaggagaaagtcaggatgcaggccaaggagcacagcayacacagagtattgaccgggaagcgctggacgtgaaccccatcctcgaaggagccgcctgg

SEQ ID NO: 1309 - DNA, 121 bp, Gadus morhua
ggccacgcccgaatccacctctgaactggaactctgttgcagctccagctccggcctcggsctttctttggtcagcgcccaggggggggcaagcaagaaacgtcttggtaagtttgtctct

SEQ ID NO: 1310 - DNA, 121 bp, Gadus morhua
gctcccaattaaatgaaactctcgaaacaattgaaagtcctcataaatgtttctcttggayataagggaattagacaaagagcacgtccatataaatggaaccgcttgaaaagcaagtcat

SEQ ID NO: 1311 - DNA, 121 bp, Gadus morhua
ctaaaatatatttggcattcgtccataccattttattttcttttagcatactatttttttwtggggggggggtgtattttattgattcgttgttaattttggggagcatagagcctatttt

SEQ ID NO: 1312 - DNA, 121 bp, Gadus morhua
atgcaggttatttggttctttacatagatacaagttatgaaccgttacatagcaatgacamttctaaccaaatgatggctccttaatatgcaatataaaacattgttaatgcacgactacg

SEQ ID NO: 1313 - DNA, 121 bp, Gadus morhua
cgaaagtaaacataaagtagtcaacacaaaaataaagctgcagtatttagagttttcattyattcaacaaatccaacatgtttacaaaataaaaataaaagtaaaatagcttaaatgtaaa

SEQ ID NO: 1314 - DNA, 121 bp, Gadus morhua
cacaaaacctgtatacgcgatatacattgtttcagggtgttttattgacgaacgtacacartaataattgcaagaacgtactctattatacatgaaacatagtgaacattcttttgggagt

SEQ ID NO: 1315 - DNA, 121 bp, Gadus morhua
cagggatcacatctgagctttcttctccaccctgatggtctcgtaggtgtctgaaatatgwggggtcaggcctgaatatatccctgctgcatcacttttctcaggatgatcttgaggtgga

SEQ ID NO: 1316 - DNA, 121 bp, Gadus morhua
cagtggtgcacatccatcttccatatgacaacactgtcaactgactcgatgtctcatccgrccgtyatagtgactgttccccctcctcctagccctccaccataagcggtatcaaaacgtg

SEQ ID NO: 1317 - DNA, 121 bp, Gadus morhua
gaaagcttggaaccatatggggccaacacagttacccaacaagagaattttaatttcaatwaaaaaaaaaagtgacttgactgttctcgcctgtgtactaaagattttagcacacataaaa

SEQ ID NO: 1318 - DNA, 121 bp, Gadus morhua
aatggtttgacttcctgttcagctttcaacttcttcttcactggtttcggttttgttgtcrgtcgaggaccaaaggggtatgaagagcaagccggccagctccacacatattccttcctcc

SEQ ID NO: 1319 - DNA, 121 bp, Gadus morhua
acattatgcatggaagcaagcaagtcagggcactggtttacactacacttaaactgggaaktgaaaaaaatcgcaaatttaaagaatagaggacaaactcaggggtcaagacsaactacag

SEQ ID NO: 1320 - DNA, 121 bp, Gadus morhua
cttgatgtcgggaacgatggtatcattgccgggcttccagccagcggggcacacttctccraacttgtcggtgtgctggaaggcctggaccagacgcagggtctcgtccaccgagcgaccc

SEQ ID NO: 1321 - DNA, 121 bp, Gadus morhua
gccgacaatctccttgtcggtcttcatcacgctgtgtattcttgaaccgatgcatttgtcmaccagctcaagcgggcacaattgtgaggggtttgttgctggtgtatgccgccaatgtttc

SEQ ID NO: 1322 - DNA, 121 bp, Gadus morhua
tgttttgaaaaggtggaaaatccttggctggggatcccagggaagcctgaggctttaattragccgtaggcggtggattcatgcagagggcaatatcatatgtattgaaagcagccaggtg

SEQ ID NO: 1323 - DNA, 121 bp, Gadus morhua
tgtgttataacaccttgctgcgtggttccaagactagtacgtgggtgtgcgtgcaggtgtstgtgtgtgtgcgtatgtgtgtttgcgtgtgtgtatgtttgtgtgtgtgtgtgtgtgtgaa

SEQ ID NO: 1324 - DNA, 121 bp, Gadus morhua
actattctagacttaaagctagtaattgccatggatgcattaattcaacaccgcagcctartgtatttccatccatcgcaccacaatacaaaacatttgatatctgcattagacaagcagc

SEQ ID NO: 1325 - DNA, 121 bp, Gadus morhua
tatttgcaaaggcatgttcaataaatccaagtgaaatgatctccatatttaataagttatygtcaaagtagattgttcaagctctgagtcaccgaagtacattcaaataaatggtttgggc

SEQ ID NO: 1326 - DNA, 121 bp, Gadus morhua
ttgcgtcctcatggccggccagcagtgtctccacctcgtcctccgtcatcttctctcctarcgttgtgaggacgtgacggagctcagctcccattacggtgccgttgccctcctttatcga

SEQ ID NO: 1327 - DNA, 121 bp, Gadus morhua
gaagtcagaatagtggttgcttatacaattctaggtactatgaagagcaataatccctttwaggttaatcaaggatttaaataaataaacaaaatccttatcgcgcgatcaacatgattaa

SEQ ID NO: 1328 - DNA, 121 bp, Gadus morhua
aacacaaaaggtaccatatgtaccactcttaaacattaaatatacttaaatcaaccagttrcattcctaaaataaatccaatctatcacacatgcccatttaaccctgktatgaccgtcca

SEQ ID NO: 1329 - DNA, 121 bp, Gadus morhua
tacataaggtaaacatatatacatacagtatatacatatttacagaccaggaaccggaggwgcaatcacacgcaggagttgtttttcgacacaaaaactggcggtcagggtgtgggtccaa

SEQ ID NO: 1330 - DNA, 121 bp, Gadus morhua
caagagccagagtcctcttcccgagtcatctcaccttcttcttcttcttcctcctccgccwcctcctcctcctcctcatccacatcaagggctatctccctcagttcctccaagttctctg

SEQ ID NO: 1331 - DNA, 121 bp, Gadus morhua
tcccgacatctgccctttggattggctgaygctctcccggagtaactggagatggccgcysttcccctgctgcaggctggagagcggaatgttgagggagatgggtagccgggatatatcg

SEQ ID NO: 1332 - DNA, 121 bp, Gadus morhua
agaaaaggatacaataaaataatccatgaatgcgaaaccatgcattgctgggagctgtgaygcagcataccggcccaaccggagatgcagcttaaacctcgtctagttcataaaaccacgc

SEQ ID NO: 1333 - DNA, 121 bp, Gadus morhua
ggtacatttccgccatagtgaaacagaaacaaaaagcataatacaactcgcgaaaaaaatyaagaggtcagtgcagaagtaagtctatgaaatataatatacatttcccccaaaaaaatac

SEQ ID NO: 1334 - DNA, 121 bp, Gadus morhua
tatgcttttagcataactaaccttccactaggagctattgggaatactattcaggcctgtsaggattgcctaagtctaggacaaataaggtcatatttcaaaaaggttaagctcacacaac

SEQ ID NO: 1335 - DNA, 121 bp, Gadus morhua
ttactgagtactttcaattgattataagtgcaatgcataagacactactcagataagacarctttaaaaaaatgcctagttaaaattccaaatgtggttaacttgtagtggtggtggcggc

SEQ ID NO: 1336 - DNA, 121 bp, Gadus morhua
ttctcgaccgctcctggttgtccatcctcagaaccaggttcttcagctcctcctttttggwggggcgctgrgaccgcttcatcatcttcttcacttcctccttctccgagcttctgatgtc

SEQ ID NO: 1337 - DNA, 121 bp, Gadus morhua
gctgrgaccgcttcatcatcttcttcacttcctccttctccgagcttctgatgtcattgaygaagcggtaggttttctcgaagatctccggcttgtattctcctgagaggtcgtcaaagcg

SEQ ID NO: 1338 - DNA, 121 bp, Gadus morhua
aagcacctgatcatgctcagagtgtgacgtatcgacggtccctgattgcatctgcacgatkttttccagaactgtccctcgttgaagaaaacaaagactgcattaggtcacacatgcygaa

SEQ ID NO: 1339 - DNA, 121 bp, Gadus morhua
gcgcttcccacagccagggaaggcgcagccgaaggcccgcacgccctcgtgctccaacagkacgtggctctccaggtggaactgccgtgtgaagctcttgccacacttgttgggggcaggc

SEQ ID NO: 1340 - DNA, 121 bp, Gadus morhua
aacactcgcgtaacttgatagcagggcgtaaagaattatgagacttctaaagagtccagawggagtccaaggacagtaagcatatcgaccggtgggggctcagcactcaagacaccggtca

SEQ ID NO: 1341 - DNA, 121 bp, Gadus morhua
agacagcacatcctcaatgtaggtgagaacggtggcgagcatgtcctgcaccctggaggcygagccgcccacctgcgacaggtccgaggtcaggcccttggtgcggctgggagtcacgcga

SEQ ID NO: 1342 - DNA, 121 bp, Gadus morhua
ggcggtgtccacggtgaggtggattgggttggtggcctctcggctgtagtactcatggatsagcaccgagtgctccgtgatgtcaaaacccggtggcgtaaccatccaatgatgaccctcg

SEQ ID NO: 1343 - DNA, 121 bp, Gadus morhua
cagaatattacaagacccttgattgcaaatgttaaacaaagggcacaaaacgacaaccatkgacattccaatttcatgccgtcacaataacaggatgggattagccaggtttttggttgga

SEQ ID NO: 1344 - DNA, 121 bp, Gadus morhua
gggcataatgccacatacattcctttgtttcttttaggtgacatctccaaagacaaaaagyatatctggaacaaaataaaaataaaatactctgattaaggcacagagataaaattaagaa

SEQ ID NO: 1345 - DNA, 121 bp, Gadus morhua
gagccgcggggaaaggtagaggcaaggaggagcagtatgtgagagtgtgaggaaagtttgrggtcctgtgtttgtgctaataggagaagatggggaagacggtgcacccacaacttttttc

SEQ ID NO: 1346 - DNA, 121 bp, Gadus morhua
ggtgcacccacaacttttttcttttcattttcacaatacacaatccttttatcttaatgakgatcgtaataagtgagtttaaatgtcagtctgtgcaatggaagtgggggtaagagaaata

SEQ ID NO: 1347 - DNA, 121 bp, Gadus morhua
gaaataaatacagtaggtgctgtatagaggagcacagtgtgtgtgctcagataggttacaraacagcattacatataccttttaactaaggaataaatacggatgtggccgtttgttctaa

SEQ ID NO: 1348 - DNA, 121 bp, Gadus morhua
ttgaaacattttattgataaaatataaaggaaaaatattcgtcgatatggataaaacatamcagatgttatgaatacactcaagtaaaaccatacatgttaatataatgcattacgtatcc

SEQ ID NO: 1349 - DNA, 121 bp, Gadus morhua
aaaactagcctaaaagtaaagtcattgaatgcatttaatttaaaaacgaacctaaaatagrgggcggtgtattttatacccgacaactgtcctatacttcatacgcccaccataaactacc

SEQ ID NO: 1350 - DNA, 121 bp, Gadus morhua
atgcattttcaatgtcaggcttatacaaacaacagttaccaggcttgaaattttgctctamattttttaactgagaaaaacaataccttggctcggtgctagatctatagatgccactgga

SEQ ID NO: 1351 - DNA, 121 bp, Gadus morhua
aaaccattttaaaacccaagaaattaccgcaacgagaataatttattcgtattgacattgkggcctaatcaattggccaagaagtatacatttttggattaatctacaaatgatgccgctt

SEQ ID NO: 1352 - DNA, 121 bp, Gadus morhua
aggggtcaacatcacctctaggaaaccaaagaataaataaaccattgacatacagctgcargcagaccttccccagcagtgtaggactcaaataactaaagaaaggaggagaaaccaattc

SEQ ID NO: 1353 - DNA, 121 bp, Gadus morhua
agtaacaaatgtgacagctagccaggaaattgcaagtaaatatatttttacagacttttamaaacatcaggatacctcgacctgctttttctccatttgctgtcacctcatactgaaattt

SEQ ID NO: 1354 - DNA, 121 bp, Gadus morhua
gatgcaagagcaatatggaattggagatcacatcaaaacaacaaaagatggacgagaacarytaaccagaattgattggcttggagtgcaagcatttttatgtatttcaagtctagtgggt

SEQ ID NO: 1355 - DNA, 121 bp, Gadus morhua
gtatttcaagtctagtgggtgcattatgtttccgcatcgctctctatgtctgactgtgtcrgttgtttgtgacttatatctggaattatgttaatactgtcaaaaaaacaaaaataggatg

SEQ ID NO: 1356 - DNA, 121 bp, Gadus morhua
gagttatcagagtattcattatttatttttgcaaacgttcaaaacacattttccttacaamaataaatatgcgtctcacaatttaaatcacgtcgaaccaaggcctgtaacagtttaaaaa

SEQ ID NO: 1357 - DNA, 121 bp, Gadus morhua
ttcttattgtagattgaataagcatccataatttacaatctgaaatcataaaatcaacaawgtatttttttatcaaatgtttggtatttgctatgtgctgataagatacagataatgtatt

SEQ ID NO: 1358 - DNA, 121 bp, Gadus morhua
agctaacaaggacttcacacctatagcgctggcctcctgaagaaggttgatttcacacacraaaaggttattatttttaaacgccacagacgtcccctcaacgtttgtgaggtaaagtgcc

SEQ ID NO: 1359 - DNA, 121 bp, Gadus morhua
tgttttttaacaggtggccataatggcactaactttccttgcatgagcatcatcagaggcmaaaagacggtaactggtggggtatatatcaaataatccaagccttataacggcttgtcta

SEQ ID NO: 1360 - DNA, 121 bp, Gadus morhua
gtatcatggagaagagctgcttgcaacacctcaatgtcaacaattgccaccttcatgactraggattcttgcaactcctataggatggttgatataaggggttccttctacatctttacgc

SEQ ID NO: 1361 - DNA, 121 bp, Gadus morhua
tttttgccattccctcccttaatataattttcattttcatttcattttataaatgaatcckagcagcgaacactcttcattcaatcaccaaaaaactttcaataatatataaagacagctg

SEQ ID NO: 1362 - DNA, 121 bp, Gadus morhua
actttcaataatatataaagacagctggcatggctcacaaaagcctagaaacaaaacaatkaaacttttcctctaattgcctaattgctagattttgaacaaggaccatttcaaagagtag

SEQ ID NO: 1363 - DNA, 121 bp, Gadus morhua
cccaccgctccacattcagaaatgcctcccgtgtgaagtttccatctgggagatgaaacayggtggaacaaattaaragacaggctgagcgtttgcatattgacattagagcttgttggga

SEQ ID NO: 1364 - DNA, 121 bp, Gadus morhua
aacatgtgtttgagcatagagtccaacacacatgaaacatgtccatgtaaagcgcagacgytgcgggggtgttcctgaatgacaaccggaatgaacgtggctatagcagacgagggtctga

SEQ ID NO: 1365 - DNA, 121 bp, Gadus morhua
catcccatccttgtcgatctcatccgggtccaacatgcccagctggactgagagcgatctyttgtcatcggcgatgatggggaaaggcaatggggtgccagtttcaccgttgaaggccatc

SEQ ID NO: 1366 - DNA, 121 bp, Gadus morhua
gaaagcagtagttcaaactcttttggtattctgttaaatcatttgacaaattaataaaatkatttcatgttggatatatatatagacaaaggacccaaaaattattttgataacacactca

SEQ ID NO: 1367 - DNA, 121 bp, Gadus morhua
tatccgttcaactctttcatgtgtcaataggtttcattcaaggacgtggctgatgtgaacrcaaacgcgaacaacggtggtaagaaagtggtatgtcctttagagagaacagaaaacaagt

SEQ ID NO: 1368 - DNA, 121 bp, Gadus morhua
tagaagcctctatctatatctatctcatgctagacaaattcaatatgaaaatatactttgytctaaatatactttgccctaatactttacatttaaaaagaatagtacattgaaaaaaaag

SEQ ID NO: 1369 - DNA, 121 bp, Gadus morhua
ggacaacatccagaacacacggaggggaacaaaagcgttggcaaatcccaccctcaatcgygagttctgattggcctatcgaaggctgccgctggatgcgagggctcgtctgattggctag

SEQ ID NO: 1370 - DNA, 121 bp, Gadus morhua
aaaaaaagcaacgctagacaagaaacacaaccaaaatattctttggaatccatggtggttkgtgtgggctcacacagtcattcatcttggcggtttcactctagagaaccctagggcttct

SEQ ID NO: 1371 - DNA, 121 bp, Gadus morhua
taatcaatcacattaggggacagtatcgaaacatcatgcacaacaacatttattgaaatgyaaagaatccattgtcaaaaataattattgctgcacttctttaacttttgtttcttaaaag

SEQ ID NO: 1372 - DNA, 121 bp, Gadus morhua
ttcacaaatgtgtacaataaaaaaaaatagaaacctcaaaaaactaaatttcttaagaggrgggatggatgggggggtaaattgtcacgtaaacagctgcatggcgactgaagaccttcct

SEQ ID NO: 1373 - DNA, 121 bp, Gadus morhua
cgtttggtgagaacagtgaggatcctacagtaattgatgtgttgtgatgtgaatactgacmatagttctgactaaaacacagtatacatgactaggaactacaaaacaacgatgtggctta

SEQ ID NO: 1374 - DNA, 121 bp, Gadus morhua
aaaattgcatagtgcggagaaacatgagggcactagttgtaggagttcccttgatgcgagrcttgggcctcgctgggggatttctgtgtgagaaggcacagggtaagactgtaagatgttc

SEQ ID NO: 1375 - DNA, 121 bp, Gadus morhua
caaatcatgcatggcagaccaggatatccatgctatatgattgaggggggaatcattttgwccagttttctggataccattatgggtggcagggttacactgaaggcaccctttttggttt

SEQ ID NO: 1376 - DNA, 121 bp, Gadus morhua
tttggttcataaacagttaatcgctgcaaaggtcaagatatatacggcatcgcggcatatrttaaagttgttccccgtcgtaggccgttgcaaaattctccccattcaagagtacatggtc

SEQ ID NO: 1377 - DNA, 121 bp, Gadus morhua
actttgccaaccaaaccattgctaacagaaaaaactaaatatttgtattgacttaaatggwtgctcactactcagtcattgttcgtatttactatgggataaagcaccaatattagttcat

SEQ ID NO: 1378 - DNA, 121 bp, Gadus morhua
tgcgtcagtgcaaacgtgttagttatggctaaccctctttattccctagaaaaatacacamcacctcgggaatatatgaaaaaagaaagcctgttgcgatgcaataaactataaaataaag

SEQ ID NO: 1379 - DNA, 121 bp, Gadus morhua
gctwggctccacctccagggtgatggtcttgccggtgagggtcttgacgaagatctgcatrccacccctcagacgaaggacaagatggagggtggattctttctggatgttgtagtcagac

SEQ ID NO: 1380 - DNA, 121 bp, Gadus morhua
atctggggggatgccttccttgtcctggatcttggccttcacgttctcgatggtgtcgctwggctccacctccagggtgatggtcttgccggtgagggtcttgacgaagatctgcatacca

SEQ ID NO: 1381 - DNA, 121 bp, Gadus morhua
cctcatttgagtaggaaaaatcgagtgtcgtggcatttgctgcaccctctctaacacctasacattctgtggctccacttggcacttggtaacaggagttcacttggttggtctcgaataa

SEQ ID NO: 1382 - DNA, 121 bp, Gadus morhua
gaaaaagttgaacggaaacgcaacattgtaggaacaattgtatgctttttgttgaaaaatkttctagaattatgcaccataggatgacactggtctgagatctgattcagggaacatattc

SEQ ID NO: 1383 - DNA, 121 bp, Gadus morhua
tttcagccaggcggcggtcatacagtgcacttaaaacagtaaaactactgcactgcagtaragtgactttacctctgacataactacctttaccacactgcactgcagtaaagtgaattaa

SEQ ID NO: 1384 - DNA, 121 bp, Gadus morhua
taacccgctggttacatctgctacagctggtggagcagactgtaccagcagataacccgcwggttacatttgccccaactgggaggacagactgtaccagtggatccaccccactggttac

SEQ ID NO: 1385 - DNA, 121 bp, Gadus morhua
gcttcttcagacttcttctgcgaraacctttttcttctgggcgacctcttcctctggcttkgggacggtctgttccttctccgtgaggatcatctcgatgtggcacggggagctcatgtag

SEQ ID NO: 1386 - DNA, 121 bp, Gadus morhua
ttgtgtgactcaaaatttgcatctcagtttgggcctgttgtatcattttttctaaatcaawcttttcaatctgtaactcagattttagtttctctatgttcatcttctcagtcttgttctc

SEQ ID NO: 1387 - DNA, 121 bp, Gadus morhua
ttttttttattagtttgggtggaattagaattgactacacatgccttttggtgtgtcgtarcgggaatctgattggttgaacattctcttaacaaagccatggtcattgtagccaccttta

SEQ ID NO: 1388 - DNA, 121 bp, Gadus morhua
ataatyaataataaattacatataaaatgtgcaaactcttgtacggcaaagaaacaaaacratataaataaattgtaacataaatgtatgacctatggctgcgtgtgataaagcatggttc

SEQ ID NO: 1389 - DNA, 121 bp, Gadus morhua
taatttctttcccatattagaacatatattgccttcatgtatttagtagtagggcaccatkggaaaccataactctttaaaaggtacagaagacagagagagrattttaggtgtgggctgt

SEQ ID NO: 1390 - DNA, 121 bp, Gadus morhua
ttctagtaataataacaaccttgttcttcctctggataattagttatgcttccttcactgyagcaaattcaaacaaatacattcaccatccaaaggtcacacaaatgaaaactacaactgt

SEQ ID NO: 1391 - DNA, 121 bp, Gadus morhua
gtgtccaaagtgatgtatgatggattgatccaactgccgccgtatgagctggtacagtccrggagaggaagttgagtggggatttgatctatccaccataaatctgggtctgtcctgtcat

SEQ ID NO: 1392 - DNA, 121 bp, Gadus morhua
agatttagtcactaatgaaatttgacaacaccagaacaattgaagtctgaatctgttctgraatatttattctggcaaataatacggtatgtgaaaaaagtagaaaccagaagaatatatg

SEQ ID NO: 1393 - DNA, 121 bp, Gadus morhua
cttccagtattggctaatatatcgatggcgagaaacacaatcttattcaacacttgatytmagcaggttcggtgtaatatgcctttgtgaatgagaatatggatgaaaccagcatagttgg

SEQ ID NO: 1394 - DNA, 121 bp, Gadus morhua
ctgaacataaatcctttaaagtggtcaagctggtgtcatggagtctgtttggatggatcgygggtgtgtgagattattttatactaatgtcatgtcattaatatttattacaatgtgttta

SEQ ID NO: 1395 - DNA, 121 bp, Gadus morhua
cataaaatgtatattgctgtgacttcttctttcacagtgctttctgtttcccattttgttrctgtcatttttgtttgttttcattttttagcacatttcccctattcctaaaataactact

SEQ ID NO: 1396 - DNA, 121 bp, Gadus morhua
agcgttgaacaggaccccttggagtctgctcgttgaaaaggtacagaccaaaaaggagagmggaagagagtgagtgagtctggggggcggtcaatgcacaagcggagagatgagttggagg

SEQ ID NO: 1397 - DNA, 121 bp, Gadus morhua
cagagagagagggcgaagggggccacaggcagtggtactagtactatcattggcagaatcmataggagtcttgctaaagacaagtaggtgagagtagacagtgatgcccttgtaagctaca

SEQ ID NO: 1398 - DNA, 121 bp, Gadus morhua
aatgattatgtacaattatctgctctttcctacattatcaattgcttatgtcatgttgatyaaaatgtattgtattgtattgtatctattgaatagtctcacccccacaagatttgggcct

SEQ ID NO: 1399 - DNA, 121 bp, Gadus morhua
ttgatttacacttcttacggatttatgtttgtttatcaaaataaggtatgaatgttaatckaattaagcaaatatagcatctttagttagctgaagtccccaaactgatagtgatgattat

SEQ ID NO: 1400 - DNA, 121 bp, Gadus morhua
ggaaaatgtcactattgaaaaagaaaaccatacatgactcttgtgaatggaaacccccggscatctaagaaccatgacaccagcttgactccaaaatgaacgataaaaactccagctccta

SEQ ID NO: 1401 - DNA, 121 bp, Gadus morhua
cttgatcatcttcatttgttctactccgttcattgggtccttaagacataattacacatgygttagctgaacaaaacagacaaggcaaggaggtcagagaggatgtccacttcctgttgtg

SEQ ID NO: 1402 - DNA, 121 bp, Gadus morhua
aagtctttatagttcccactgctagtctctctaaaaaaaaagagtcccagcgataacaatyggccgctttaaaaacaccaagtgtccttgtcagcataacgttcattaaccagaaaacaaa

SEQ ID NO: 1403 - DNA, 121 bp, Gadus morhua
agcagcatattcatatttacatcagtgatatatggcactaaaagtctgctaacaaagaaakaaattaatcaaacacattgacatagtatgcaaagccatgctgataaatgyaattcccctc

SEQ ID NO: 1404 - DNA, 121 bp, Gadus morhua
acatacaaaatgaatgctcatacacctgtgaaaaaggctgtcctttctgctacgggtaacraggtggtgctgttagcaccagtgatctagggctaatgacgtaggtgagaaacatgctact

SEQ ID NO: 1405 - DNA, 121 bp, Gadus morhua
gaatgacagtttagtactatatggcacattgttttgtttatacatattgcttttaaaagamaaactatcaatcttcctcttgtcaaagttaccttcatccagggtattggcatattaaatt

SEQ ID NO: 1406 - DNA, 121 bp, Gadus morhua
taggtagcctattagattgatgagggcagtcacttttgcttgtattcagaaaataacttcmaatttccaacagtgattcttatctttaatggaactcttaataatgggaaattttacgaaa

SEQ ID NO: 1407 - DNA, 121 bp, Gadus morhua
gaatccaaagaaaagtaatacaacagaggatcaaagcagcagttcaagcttgcaagacacmttgttgtatagatggtggtaacattaccaactatcattgccactgtaaaagacaagaaaa

SEQ ID NO: 1408 - DNA, 121 bp, Gadus morhua
aggacaccattggaagttgagaacctattgactgacaggcagagttaagacgaagcaagcmtgtatataaaatgcttgtcttttgctgcgtccggtttggcggggaaaaacaaagcaggta

SEQ ID NO: 1409 - DNA, 121 bp, Gadus morhua
ttacaaacacaataaagaaagatctacattcttgttaaaaagcactgtgttatctattccytttaattcagactagttctcttgtaatcaattattgttctttttattatcattgctgagt

SEQ ID NO: 1410 - DNA, 121 bp, Gadus morhua
gaggagaaagtctgtctcactgtcctccttctgcggcctcctctctagaaacggcagtagwaaggtttccacgagccccccccggtggccccagtaggaccagcatggagccmatcagata

SEQ ID NO: 1411 - DNA, 121 bp, Gadus morhua
caaagtgacttacaataactattaggtgaaaattgtttgcaataacaaacattggcagtawtcatyattatattattgtaattgtatagtactaagctcaatttatggatagctttgtagc

SEQ ID NO: 1412 - DNA, 121 bp, Gadus morhua
cgtcctcctttctctcatagcccctgtagccatgttcaacctgcccctgatactccctggrggaagtccttcactcagcgagtgcagccacggccatgttgaaacaccgtcatcaagtcta

SEQ ID NO: 1413 - DNA, 121 bp, Gadus morhua
gaggcacccagtctatgcggcaagataataaaaaaataactccctcaaaagtagaaaatcsaaacaatctgatgtccttaatttttgtgctgcactgcaacaggaaaatatacagttttat

SEQ ID NO: 1414 - DNA, 121 bp, Gadus morhua
ggacagaaaaaaaacctgtttgttataaaatgcttctttcttcgtaagtggattttttttkgttttgctacagaaggaatgaaaatttgtgtttgttccatttcagtttgtgtatgctcat

SEQ ID NO: 1415 - DNA, 121 bp, Gadus morhua
gttccatttcagtttgtgtatgctcatgtctacggtgtgctcgcacgcacgtggatgcatytcaaaaaaaaggttttaacgtaaaccgtgtttttttttttcttcttaatttctgaatcct

SEQ ID NO: 1416 - DNA, 121 bp, Gadus morhua
cgcttttgctgctcatcaaagctctaatctttaacatttgagacgagattgacagcacagstccggttctgcagctctactccacagctgaaaccaagacgatatgaaacgtacaccggcg

SEQ ID NO: 1417 - DNA, 121 bp, Gadus morhua
tacaaccatgatgcaaaaacactctctcttcccttactctcttctacaaagcatgcggttygtttgacttaacttagatcaagatgtcattatgttgatagaacggcagagtttgattcag

SEQ ID NO: 1418 - DNA, 121 bp, Gadus morhua
ggtttgttccaagccagcagtgcaaaaaaaaaaagcctacagcaagaacaaaaaaaaaaarragaaaaaaaaagaaaaaatatagaaaatgaatgaaaagtaaagcagacattctcacctc

SEQ ID NO: 1419 - DNA, 121 bp, Gadus morhua
atgattccaatcaggtcattttcagatattcataaaacaattgaagaaaaaaaaaaaactwaatgcaaacaagtaaatttaaaaaacaaacttaaaagggggaaaataattyattaacaaa

SEQ ID NO: 1420 - DNA, 121 bp, Gadus morhua
atatagacaaaatatagctttacatcataataaagcatttacagttaattctatcaacgcrtttcttctgcgattaagtctcaaacccttttgctgtttgcatttcctgcagtccttcgtt

SEQ ID NO: 1421 - DNA, 121 bp, Gadus morhua
taaggtacagccataataacataataacagcagctacaatcatacatttctttcttaaatmtccaaggataaatctgacgtgcagtgcatgtaaataaatgtgtttataacgttcgtaaaa

SEQ ID NO: 1422 - DNA, 121 bp, Gadus morhua
ataaactagcagctgatcagtgaaccatgcagaatggatacggtgctataagcgaagcagytacactgaatgccagccagctcacaccttttgtggtatcaataaatacaacacaccatcc

SEQ ID NO: 1423 - DNA, 121 bp, Gadus morhua
gaagcccctgaagagtctcgacctttgacctttacgatgtggtaaatacactgtgttcatstatcagtactggcagcacttcacaagcgcagaccacccaaccaaaccctctttacgtctc

SEQ ID NO: 1424 - DNA, 121 bp, Gadus morhua
aaataaatccttctttataacatcaattgaacagtctgtgtcaaccaaagtgagtaatacratcacacaaagaacacctgtgacattccaaacgaatctaaaccagaactcaaagccattt

SEQ ID NO: 1425 - DNA, 121 bp, Gadus morhua
cgtcaacatgagtccagcaatctatcctcctgaaccttttattttttcatgccacactatkagcgtgtgttaatcacttatacttgtagaaaccctctccagtctttctgccatatttgcc

SEQ ID NO: 1426 - DNA, 121 bp, Gadus morhua
aatgatttttgtttccaaaaatctttacaacgaagtttgcgttatctttacaacgaaatargtgttaattataaggagtcagggttctgttcagcattgttagggcaagtattcccttggt

SEQ ID NO: 1427 - DNA, 121 bp, Gadus morhua
tgcctcaaagattacgaaatttataaaaatgcaacaaattacacaacctttaggagtatcyctaccaatttattttaaacaacactatttattttgaacacagtaatagtgaattcttgtt

SEQ ID NO: 1428 - DNA, 121 bp, Gadus morhua
aggatgtgacctataaattcaccaggcacccgacgaaactccaatttggttttttttatcmcctaaagaatgtcctttgctgtatctaaatcattcaaatggagggaaaaaaaaaaaaaca

SEQ ID NO: 1429 - DNA, 121 bp, Gadus morhua
ggggtgcccccttaactgcacataaagaattccaaaaatacacctgtggctgatttcccasgccccacagaaggcaatcttattgtccttacttcagacagccacaggaggcgctagacat

SEQ ID NO: 1430 - DNA, 121 bp, Gadus morhua
tgtgaccttataaattcaccaggcacccgacgaaactccaatttgtttttttttatcaccwaaagaatgtcctttgctgtatctaaatcattcaaatggagggaaaaaaaaaacaacacaa

SEQ ID NO: 1431 - DNA, 121 bp, Gadus morhua
aaactgaggttataaaaggtgtgggtgtaggtcaacgtgtggttaaacacaagtcattggktggatgtaatccttggtcaatgacagtcagttactgattggtcagatgkgagchatggtc

SEQ ID NO: 1432 - DNA, 121 bp, Gadus morhua
ctgattggtcagatgkgagchatggtcgttttctacataattagtagtagcgtccatataytacgatgttagcatagtttctggtctgtgaacaacagcatacagtacttgtactgaacat

SEQ ID NO: 1433 - DNA, 121 bp, Gadus morhua
catctacatctatcctaatattaattacaagcgtatacaattagcagcattgtttgtacgyggaaactgaagttccttaagtaaacctggggagaaaatatgtcaattgttttgagaaaac

SEQ ID NO: 1434 - DNA, 121 bp, Gadus morhua
caaataaacatttgatttataaataacaaagctctgtatgagattagatttgaggaatatwatcattagttagcaacctaggccctctttagctgaattgaaagccccaaaatattctata

SEQ ID NO: 1435 - DNA, 121 bp, Gadus morhua
ggatgctacatgtacactaagatacatcttggaaggcaaaacagaagcaagcgtctcccaycaaaattttccaaatggcgtaaccaaaatttagggatggcatgtgcaacaggatactaag

SEQ ID NO: 1436 - DNA, 121 bp, Gadus morhua
cattctggccctggaaaaggacttgatgttgggggaactgggccagaattccaggggaacytctcctctaacatcaggggaacactccatcagctggacatctgcacagcttagctgtcca

SEQ ID NO: 1437 - DNA, 121 bp, Gadus morhua
tgagctcccctggaggaaatgtggctgccccccagtggttgggggtgattccaactgtttrggggcgttgtggtttggtctcagtcttcctagaaggaaccgaattcaggaccgtcttcct

SEQ ID NO: 1438 - DNA, 121 bp, Gadus morhua
tatttgacttataaacaataggacatatccgctgtgggaagaatgatttataaaaaaaaamcgtaacatttactatataatcatggtataaaataattccatggcacataaagttaaccat

SEQ ID NO: 1439 - DNA, 121 bp, Gadus morhua
agtttcttcatacgtttcgctgacagttttggtgccgattattccaacagcaggttctggmacagtcttcacttccaggacactgaccttgcgtcttggtgtagcggggctttggaagtgg

SEQ ID NO: 1440 - DNA, 121 bp, Gadus morhua
aaaaataacacaacaggacctaattcaatgtcaagtcacttatggtttgctaaaatgtaawatgtattgagccaaaaaaaagatgataagaacgatcccaggagtacaagttgattataga

SEQ ID NO: 1441 - DNA, 121 bp, Gadus morhua
gagattaaatgtctctaacctcatatttaccctttatataagcaacatactcagaattcayaataaaattcacatggttttgcttcaatgcatatcaagcttttttaaattaaggcatacc

SEQ ID NO: 1442 - DNA, 121 bp, Gadus morhua
gacacctgctgattgccgtacggaaagggcataacaatccattggtcaaaaaaaaaaaaawaacttttcatctccgacttatgtacacattacatattatccaatttctctattctaaata

SEQ ID NO: 1443 - DNA, 121 bp, Gadus morhua
tgaactgaaataacattcatttcaaracaaaaaaaaaagacaataagctaactgaattaakgttggcacaataataccagcaagagtctagtatagttgtaaaaccaaacaaacaactggg

SEQ ID NO: 1444 - DNA, 121 bp, Gadus morhua
ttatttgtagagcactttacattcgaaaatctcaaagtgctatagagtttcaaagaaaaawaaaccctaaggcgttaccattaaaagaataacaataatttataataattttaaattaaac

SEQ ID NO: 1445 - DNA, 121 bp, Gadus morhua
tatattggttccaattgcaatgcccgtaattccctggcattctctgggtccaatccggcaragtactatattgtattacctgtagtttactgagtactagaggtaatacatagtactcagt

SEQ ID NO: 1446 - DNA, 121 bp, Gadus morhua
catctttagaattaaatatgcaatattcctttgacatattttaaagtagaatattaatttmaatagatgcaaatgttccatgttagcatgagttcattttaattggggaaacatggttcgt

SEQ ID NO: 1447 - DNA, 121 bp, Gadus morhua
taggagggaggatcctcgtttgggtcatgaactctgacctctaacctattctcaaaagtcrgggcatacagtggttgagggaacagttgttacccgctctgtgatcttcaatggtgtcatg

SEQ ID NO: 1448 - DNA, 121 bp, Gadus morhua
tcattggttacaactaacattttatagatcaatggtcataccatggttggctgtgcagtayttggattgctccaatcggtccgaggaagggttattacgggcttccccaaggaccaagagc

SEQ ID NO: 1449 - DNA, 121 bp, Gadus morhua
ggcacagattttgtttaatttgacaattcagcttcaaaacaagtaaaggtaggtaaaacakcttgaaatcatatctctgtggaatttgtagtatttatrattatattattcatgggttgga

SEQ ID NO: 1450 - DNA, 121 bp, Gadus morhua
ttttgaagaatcagcaaagcaaaatatgtgacacttttaaagtgcttatcatttagtcttytttgaagaatgcaagaaaaataaaatacccaatatacattttgtgctgtggtcggcagaa

SEQ ID NO: 1451 - DNA, 121 bp, Gadus morhua
aaatgtgtgaagctagtgtaatttgaaacttcccctctgcatggcttatttcttaaggcaktttaatttagggcgtcttggccaaaatcagtggtaaaaaggttatgtaactagcattatt

SEQ ID NO: 1452 - DNA, 121 bp, Gadus morhua
ctggtcatacaagtccacgaggggtaggtagttgtagaggaggaagccctccacgatgagkatgtggatccccgtcgtctccgggtccgacgtctccgtttcaaccgacaggttgactcca

SEQ ID NO: 1453 - DNA, 121 bp, Gadus morhua
aagagaaataagccagactcacattagcaactttaatggtttaactaacatgaaacacttkgagacattggtatagaacatgtaagtctcatcactttaaccacttcatctcatgccaggt

SEQ ID NO: 1454 - DNA, 121 bp, Gadus morhua
aatctgaagaactttgcaatccatttcgaacaaacatgttcccatgcccggggtagacagrccccgaacagaaatagcatttttcaatgcgcattttgggtcctcgttcctgaagaggacc

SEQ ID NO: 1455 - DNA, 121 bp, Gadus morhua
ggaagcttcctcctcgctctggcctccagacaggaagcagacgccgggtaccgcggacggracggttctcctcagagcggtcactgttgccatgccgacctcctcaggggtgaacttctgg

SEQ ID NO: 1456 - DNA, 121 bp, Gadus morhua
cgcaatgagccgcagacagacaacagtaccagatatattgagacaatgttttttatttttrttcttattagaattcccttaacattggaaaattacgtactgtttccaaaccacaaagaaa

SEQ ID NO: 1457 - DNA, 121 bp, Gadus morhua
tttctttgtggtttggaaacagtacgtaattttccaatgttaagggaattctaataagaayaaaaataaaaaacattgtctcaatatatctggtattgttgtctgtctgcggctcattgcg

SEQ ID NO: 1458 - DNA, 121 bp, Gadus morhua
tgctaaaatcgactgtgtacagtttaacagtgaaaaatagctaaaaacaagtagaagagtytgagtgttttgggggcgctagacaataaaatgcacgtataaacaatatattcaaataaaa

SEQ ID NO: 1459 - DNA, 121 bp, Gadus morhua
tatctttttttttcttttgcacattccggaaatcaggacaatcccgtccgagaaaacctawacgagaacgggagtggacctgcatcgtagaaaatattgccatatatgtcaggtgctttcc

SEQ ID NO: 1460 - DNA, 121 bp, Gadus morhua
caagcaaagccaagctagaccggaaacgcaagaccacccgtcgtgccagcgtttttgttamagacatgtccatactacgatcacagtcatcagccaggggcgtgctcatttacctccctct

SEQ ID NO: 1461 - DNA, 121 bp, Gadus morhua
ggggcgtgctcatttacctccctcttaccctagccctaaccctaaccctaccctacagctrctaacagaggcgggggggcctgtaagtagctgattacggacattacagcagccggtgtgg

SEQ ID NO: 1462 - DNA, 121 bp, Gadus morhua
cagtgctttacatttaatgaagttctattaaaaaaaactaaagtgtagtacttgctaaatrcttgcatagttaaaaagtgttgcacatgcatttatcctgtaattaacgctgttggtttca

SEQ ID NO: 1463 - DNA, 121 bp, Gadus morhua
ctacctattcattgccattaccgagggaaatagggttgtacaaacaccgatgccattcttycagtgcggtactgagctggtgacccactaaatcctacaatgcattatatctccaaagaaa

SEQ ID NO: 1464 - DNA, 121 bp, Gadus morhua
actactgccagatccygtaaaaatacaatataccttaaaatctgtggtggacttcaaaatkgtggatttaaactgacttaaaaaaacatgtcaaagaaaatagaaaaaaaaaaaaagagaa

SEQ ID NO: 1465 - DNA, 121 bp, Gadus morhua
acgcgttttctttgcacagcttccggtacggcactcatccccacgtccagtccacttcagrcgattcctggcaaagatggcgtagcttttgtccatccagggcctcaaaggggcccacatc

SEQ ID NO: 1466 - DNA, 121 bp, Gadus morhua
cagtttctagagaatacaatcgttaaaacaaatctataaatagtcacttaaagcacagggmcatctagtctttttagagaacatgaaagtgtttccctgtaattgtcttattgttaactga

SEQ ID NO: 1467 - DNA, 121 bp, Gadus morhua
ctgcatagtatgcaattaattttgcaagtcattcaccaaacataaaaaataaacatctacrtcaagacttaaaaaaaaaatggaacagatcagatatcaagtgtaattgaatgaacccaca

SEQ ID NO: 1468 - DNA, 121 bp, Gadus morhua
caaaggcattaaattggttaaaaataaatctggaaagtcctacaacgttctacaaattaamaaaaagtcacaaaaagaaagtcacaaccaaacgtacaaacatctgattcggaatgtcaat

SEQ ID NO: 1469 - DNA, 121 bp, Gadus morhua
tccataagattacatatatttccgtatcctagtgatataatccacaaagaccacagttctyagtcgctctctccgtcgtcactgatgatgccctgcaggttcccccagtkyctgsttctgt

SEQ ID NO: 1470 - DNA, 121 bp, Gadus morhua
actgccagagttcactgtccgcttgtaccttgcggcaggagaagagtgcggctccttccakgkcgatggccctctacgtgtcggacgaccttgtgtggttataatgttgctgacatcaagc

SEQ ID NO: 1471 - DNA, 121 bp, Gadus morhua
aggagggggttgccgtctccatgrtaaccggacgtggttgttgtctccatggtaacaggasggggggtctctatggtaaaaggagttggtttacaacaggtctccatggttatagggagtg

SEQ ID NO: 1472 - DNA, 121 bp, Gadus morhua
gaatgacagatgcctcccccaagtaagaacatatacagaacattgtttataaagcccaacrtttataacttattaaataagagtcattctggtttttctattgtatttaaaccataaatga

SEQ ID NO: 1473 - DNA, 121 bp, Gadus morhua
ttagatcggtttaaaagagagagtgagaggggagaggagagaggagagacaagatgagagrggagggaggagagacaggatgagagaggagggagcagagacaagatgagacaagggttga

SEQ ID NO: 1474 - DNA, 121 bp, Gadus morhua
gtattatcctaatggtgttaatacaaatgcagttgaacatgttctatcatattttaatgcmattcaactatgtaccaatgttgacatggtttgattgcatttcaaatttctgtacaatatt

SEQ ID NO: 1475 - DNA, 121 bp, Gadus morhua
agaatcggcttggatcgatagtgttatttatttgtaacagtagattaaatgaagccattcycaataaagtcacatcatttaaataaacgataaagaaaaatttagtttttttgaaaagcac

SEQ ID NO: 1476 - DNA, 121 bp, Gadus morhua
gatgctatcctatgcgggaggccatggagcaggcccctatggctgtgttcctcaggacggycgggtagagctccgccgtgtaggcaaagatgagggcaaagcccagcgtcatcccaaattt

SEQ ID NO: 1477 - DNA, 121 bp, Gadus morhua
acaataacattaagcatgttgtgttaattccacaacaggagatatgtaatgttacctaaawtaggtttgaggaaaaataaataacccaaatatcgacatcggtatcggctgatatcggaat

SEQ ID NO: 1478 - DNA, 121 bp, Gadus morhua
ttgtgcatttattcaattaaggttattgagttttagttaaagaaacatactgctatgttkyacatagttgttcaggtacaatgttttatcattggtgaagtcgagtttgccctatttgttg

SEQ ID NO: 1479 - DNA, 121 bp, Gadus morhua
tgttcaggtacaatgttttatcattggtgaagtcgagtttgccctatttgttgtgggcatygtcaagattatctcagggagagtgtaatccaaactgttggtctgagacccatttaaacaa

SEQ ID NO: 1480 - DNA, 121 bp, Gadus morhua
tttaccattgcagaaaaagttttgtaaagaaaatctaacagagggaagtcagaggttgatraagtgagtggttctcatctgcctgtgaaccggtctgctgtgaggagaggccaccagactg

SEQ ID NO: 1481 - DNA, 121 bp, Gadus morhua
gaaaaccgataagagtgctattgtgtaatgcttctgaaacaccggtacgtcacggaaagtsaaattgaagttttttaaaatactttatatatatatatacatctatataaagacagagtat

SEQ ID NO: 1482 - DNA, 121 bp, Gadus morhua
ggcggctctgcactactggggcctggagctgcacggacatgcacatgatcaaaaacctgayggcgagctcgtgcagcacgtcgctgcgggtgtctgtgctacatgggttctttaccgagtg

SEQ ID NO: 1483 - DNA, 121 bp, Gadus morhua
acaaatttgcgaaacatgcaaagatctttgagaatgcttcacaaataccaaaaatgtaagmaacattgtttctactcgtaaaagaggatacttgtaataaaataaattggattaattaatc

SEQ ID NO: 1484 - DNA, 121 bp, Gadus morhua
gtcaatatcagagttcttttaaatttaagctttatagacaagttttgtttttgcttaacakactctggacgagtctgtcaagktttgatacccaaattggattctggagattcttcttcct

SEQ ID NO: 1485 - DNA, 121 bp, Gadus morhua
cgactttcaaacatagtttgtgagatcaaagcatatacacagcagttttccaacttattcsgtttaaaaaaaagtgttaaaggcmtggggaataccttaartattagcaaattcttgccaa

SEQ ID NO: 1486 - DNA, 121 bp, Gadus morhua
tctttctgcattggagcctaaaaacaaacattatgcaatcttctgggacacaaaaacgaargattaaaaaatacagtttataaacagaggaatgtagtcaatgttcgatttagtagcgatt

SEQ ID NO: 1487 - DNA, 121 bp, Gadus morhua
ggattcactcaaatttgacattgcaacaacatttgttttttgaatttataaaagattatgmatataaaccattattaaaccaaagagaaaacccaaactacttccgattgacctttggtag

SEQ ID NO: 1488 - DNA, 121 bp, Gadus morhua
ttcatgtgagcacccaccaataaaaagttgttagcaaatatatgtataacaaataacattyctatttgttaaaatggcctctgttaagaaaatgtaaacatttgtgggccaaaataatcta

SEQ ID NO: 1489 - DNA, 121 bp, Gadus morhua
ttgtgggccaaaataatctacattttaagaaaaatagaagtgctcgcccgaacactttttkgttttgttttagttaaaatccawtttactctaaaagctcctaaattagacatgaaaaact

SEQ ID NO: 1490 - DNA, 121 bp, Gadus morhua
ctttgttccgcgcagtctgccggtacgacgggcagcgatgagaccaaccttgcgaccagcmggtgcgtccctcctgatggtggagggtttaccaatatgctgatgtgttaccaccaccgaa

SEQ ID NO: 1491 - DNA, 121 bp, Gadus morhua
gttgttcaattttttttaaaccatatcattgcacaaagtaggatttgaagctgaatactgsattgttgtgtgtgtgtgtatgttgattacgaaatgtggcggtgggtctcttgctggtgtg

SEQ ID NO: 1492 - DNA, 121 bp, Gadus morhua
gatcgcctgtgttacagcattactgagaacaattgcaccagctcatctagtcaggctcagrgacgatgtttacacacaacggttaactgtataatatgtggtttttttacacgaaagaata

SEQ ID NO: 1493 - DNA, 121 bp, Gadus morhua
tgtacatgataacagatgacacaaacatgatgatgatactggttatggaccacactcctaygctgagacggactgtgaagatggtcttgctgtgcacgtgaggctgcatgtggtaggagag

SEQ ID NO: 1494 - DNA, 121 bp, Gadus morhua
gcacgtgaggctgcatgtggtaggagagcagagtctggctcaagatgtacagagcccccamcccgaaggtcatcacaggtcccaatgatgtgcatgaagaacagcgttggttttctgaaag

SEQ ID NO: 1495 - DNA, 121 bp, Gadus morhua
gtgtttgarggytggggcttgtatctagggagcttttmttgtactcaacagcgctcccagygggcataagagtcaccgtggcccagtcaaggacgttggcatcagagaaatcttccccagt

SEQ ID NO: 1496 - DNA, 121 bp, Gadus morhua
ctgcagatggctgctgtagttggagcccatgttggacagagccgacttcttctttgcatcytcttccatcttttgcttggcatcagcctcctccctcttcagcctctcctcctcgcgtctg

SEQ ID NO: 1497 - DNA, 121 bp, Gadus morhua
aataggcacactatacaatcaataattgctgtcagagtcaatgaaataccacaattgctcsgattgctaaaattactaaataaaactatttacagatttgaaaataataatcacctacata

SEQ ID NO: 1498 - DNA, 121 bp, Gadus morhua
aacattgtttgaatctatatataattgataactgaacatgattcacaaaaatacatatcakattagaaaataaaaacagaagtcacttcattgtcaaataaatacacacaagaaacaaata

SEQ ID NO: 1499 - DNA, 121 bp, Gadus morhua
taatctgagtaatttattacccttgttagaataattcaccaagaagcatacaaagtcaacrctcctccagtcgagtttcaaaacacaatttggtcatataataatcattagtctcagaaga

SEQ ID NO: 1500 - DNA, 121 bp, Gadus morhua
aaggggttcttgattccgtcctgtacagaaacgggttcgttcatcatggtcatgggtcggwtcttcaatgctgcttctctcatgctatggtagacgtactcgttctgcgtgaacatcctga

SEQ ID NO: 1501 - DNA, 121 bp, Gadus morhua
catctctgtctgcatgcgcattgcctctaggtcctgagtgatggggtgagtaggtccatgrgtgaccatgagaattgcataggccttgcagatcatcccgtggccaacgtctattaatcct

SEQ ID NO: 1502 - DNA, 121 bp, Gadus morhua
ttggttgccgtcaattgatatttattgtcaattgatattacgtagcaagatgccccttttmaccaactatagccaaagagacatcaaaaatgttagcaccacacaccttgattttcagggg

SEQ ID NO: 1503 - DNA, 121 bp, Gadus morhua
attggccaatctgatttgtcttgacacgattgcgattcagcctacgcatagcatgcgctgygcgcaaaaatcacagccagacacaagaactcctaattcaagagcagctttttatttaatg

SEQ ID NO: 1504 - DNA, 121 bp, Gadus morhua
gataataaaccaggtaatgcatggctccttcccatgtagctctctcgcaacaacaccaaascaaaatgtaagtgtaatgtaagtttatggctgaatgagaatcacatgcataatatgagga

SEQ ID NO: 1505 - DNA, 121 bp, Gadus morhua
agacatgcacagtttatttataattatttacaaaaccgcagtctccaaattttccaccccycatccatctcaaatattcccccttttaaccaattttatgacgaacccgagcagaacctaa

SEQ ID NO: 1506 - DNA, 121 bp, Gadus morhua
taaaaaaataaatctttaaaataaaccgatggcatccaccttttgggcatgctgttcccasgactgtattgacagttgtgccctgtgtaaaacacctcggcgttatgcaacatcaaaacgg

SEQ ID NO: 1507 - DNA, 121 bp, Gadus morhua
aagcaaatatctgaaagcaaaaaagcgttacatgttcagcaaaagctctttcctggtctcygacggaggcccttcagcccagggtgacgatgcaggacttgtagaccgatctgtaggcgtt

SEQ ID NO: 1508 - DNA, 121 bp, Gadus morhua
aaatgttgttgattttctgcaggatgtaacgattcaaacagttcggctctaggtctggatrgtgttctatgcatgtaggggagactggagcctgtttacgttgtggtacgactaagagagg

SEQ ID NO: 1509 - DNA, 121 bp, Gadus morhua
gtcagaacaaaatggttctgtacattctgtttaagcatcttctaatgactttcaacgaccraatcgttggggaacgggtgtaatcataaacaggttggaccaaccaattcagtctaacctc

SEQ ID NO: 1510 - DNA, 121 bp, Gadus morhua
ggcatgtataccgatgtgtaatcactgtgtactcgcccwgtcggaagagcagagtagagamtggcaggcagacagccgtcataaagaccctggcccggggaacggcccgttacaaaacgtt

SEQ ID NO: 1511 - DNA, 121 bp, Gadus morhua
ctcatgaatccggcctccccatctacactctgaccctaacatgggttccttaagtctccamcacctgtgcaagtgcctcattgtgcaatcagattcagattcagcgtcactgtaactttaa

SEQ ID NO: 1512 - DNA, 121 bp, Gadus morhua
cagccctgtgaaagaatacattatacatcctaagaacatgtttatgaaaggaaaccgtatytgtgttgtatatatattttttatcaatattttattaatacatttttacagtattagtcga

SEQ ID NO: 1513 - DNA, 121 bp, Gadus morhua
tgaacaaatacaagaagaataaggaataaaatggtaaatacagtaatatcatacagcactyttacaaaataagtacacacagaatgacatgaatggtgagctcatattgcacatcgtaaaa

SEQ ID NO: 1514 - DNA, 121 bp, Gadus morhua
atgcaggttaacacaatgatcctactatccaagtttgtattcaacaataaatcgcctaccrtcactgtcagagtagggttcagagagagagagggaaacggaggaagagagacatttggta

SEQ ID NO: 1515 - DNA, 121 bp, Gadus morhua
gattagcatttacaatgtacatagagaaaacagagagcagataaaaaaatacaatacagtkgataaaacactgactcaatttatgaaatggtctaaaataatgtttaaactcttgaggccg

SEQ ID NO: 1516 - DNA, 121 bp, Gadus morhua
atgcttaacacattcacagtttagtcgtcgcttatttccatcggccaaagaacatcctatwacaaactgcttcacagcacgcgacagagtgaaccgtgatcactctttgtatgtggtctca

SEQ ID NO: 1517 - DNA, 121 bp, Gadus morhua
gatagcagcgtggtgaccctgcttcaaccacatctctgcaaatctgcgggccgggaaggargcaacatctggtgcatttacagagatgaaaagcagattgtgcagtgtggacacattcgtt

SEQ ID NO: 1518 - DNA, 121 bp, Gadus morhua
ttacagagatgaaaagcagattgtgcagtgtggacacattcgttctgtttctgccatctgyaagaatgtggttcatggcgctgaaacctctttcacactcggctgtgsacactaggagcgt

SEQ ID NO: 1519 - DNA, 121 bp, Gadus morhua
ggcaagctatgaaatccaaactacaggtgaaatgggtgtgtgtgtgtgtgtgtgtgtgtgkgggggaggggatagaacgagggggtactgggatgattttgtgggtgggaaactgtactag

SEQ ID NO: 1520 - DNA, 121 bp, Gadus morhua
ttcattgtacaattattaatggtagtgcattcatccattaacatggttatagttttgatcraaaccgttgtggtgtggcatcacccattcagatgtcatgtattcacaggcactcatttca

SEQ ID NO: 1521 - DNA, 121 bp, Gadus morhua
gtcatgtattcacaggcactcatttcaaactcattttgtatataaggcaccagcaaaaaawataactttctattgactaatgccttgggaaatgttctttcaggaagcccttacagtttaa

SEQ ID NO: 1522 - DNA, 121 bp, Gadus morhua
agatcacctgtccaatcttccaggtgactgcaatggcctctgatgctttgcagcagaaagrtatagacctggctgcagcatacaaagttgttgatggagtttttcagaggctggcccacag

SEQ ID NO: 1523 - DNA, 121 bp, Gadus morhua
ccatcttcacatacacaggacgaggggagatctgacaagatatgcaagtattaatgagggrtgtggttttacacctaaagaacatgaagggtgggtccttaaaatgggtgatttattttgg

SEQ ID NO: 1524 - DNA, 121 bp, Gadus morhua
actataatcaaagcgttccttgtcttaaaccatggcaggagcagaatccagggtaacaacktattttcctttgggacggcctcattgcattaataactctggtctttttgactcaaccttg

SEQ ID NO: 1525 - DNA, 121 bp, Gadus morhua
ggacagcttgagagataggcctaacacaagccgggttattcaggtttcaatgtaraccccygttttattggtttaaaaaacaattgtatgcaatggactttttaaatatgaggacactgtg

SEQ ID NO: 1526 - DNA, 121 bp, Gadus morhua
atgctccagaaagcaatccaacgatcacagagcagccaggccagacaagaggaaggcaaaraggctcagcaggatgaggacgggtgtggcctaaggtacgtgggtggagctttaaagctcc

SEQ ID NO: 1527 - DNA, 121 bp, Gadus morhua
caagccgcactctcaaataatttattattatttgaaccaatatcgaatatttagcattggwattatgatattgttacacattatatcagttaataaagaacagtaaattaatacattatga

SEQ ID NO: 1528 - DNA, 121 bp, Gadus morhua
aagaacagtaaattaatacattatgattaaggacacacaataggcagtgttatcattaccygcatctggtttcacattcaaatatcattgtaatagtacttcttcagttagtgtccagagt

SEQ ID NO: 1529 - DNA, 121 bp, Gadus morhua
agttgacaccgatttgagatcggccacactaacccttgtttcacagttgacatacagttcytccacagataaaaacaattgtattttttttaactgcgtttcaaacgctatggtgtaaaga

SEQ ID NO: 1530 - DNA, 121 bp, Gadus morhua
ctgggctgataaagatcacattgttccgttaaggcaaatacttcattaaactaggagatgrgggttagcttgattaaattggaatagggcgagtaaatgtttaacgatagtgtaagtctag

SEQ ID NO: 1531 - DNA, 121 bp, Gadus morhua
ccacagcaatgcagaacactgtggtagatagaagctactgtggtgccattgtagttggggkctgcggcttcggcaactgaagtgctgtagaactttttgaacttcctcaataatctgctcc

SEQ ID NO: 1532 - DNA, 121 bp, Gadus morhua
gtaacaggcttgctactaaatctaatgtgagagtaatcttaatccttcagtgcagcaagtrcaatcctaaaacgttaaaagtacatatggacataaattacatcactgacaaaaacgtgag

SEQ ID NO: 1533 - DNA, 121 bp, Gadus morhua
gtccgacgatagaaagtgttgacgaggaccttagtgccggtggtgactgtcactttgaaaytgtcgccattttcttcaatttcagaaagactcttgatgtccttgcctttctggatgagct

SEQ ID NO: 1534 - DNA, 121 bp, Gadus morhua
caaattctcaaaaggcacaactattttgtatggaaaccgaatcagtacatatatgcatcgsgcttgatatcatcgaagatggtcttgcaggaatatgacatgtgtgtgwctcagatgtctt

SEQ ID NO: 1535 - DNA, 121 bp, Gadus morhua
gtcagtggcatccttgaacgataaccttcccgtgtcaagaaatatgctgcaatccaaaaamcaaatcactttaatggattggaaccattacagtctttgtcccagtacatcttctccaaat

SEQ ID NO: 1536 - DNA, 121 bp, Gadus morhua
ggtgaagtaaagtcttagtattcatccacggttatctgctttggggatggaaagaccccgstctttcaggacctgcatctttactttctccggctcctgtttggcctgctgctgcagtacg

SEQ ID NO: 1537 - DNA, 121 bp, Gadus morhua
caaagcacgatatcttttgacatgccattttatttaaaactatacaaaaatcattcaatgratctagaggaaacacgttttgtgcgcctcttatttttaaatacattttgcctgataaaag

SEQ ID NO: 1538 - DNA, 121 bp, Gadus morhua
aggactaaccacaggtacagacgcacaacaaacctctgttttacacactaagtaaagaatyctcttgggtaaacagtgtaaaacaagaaaaccagaaaagtagcgaccgaggttgacattc

SEQ ID NO: 1539 - DNA, 121 bp, Gadus morhua
ttatgtctcccgttctctcctgtgagcagtcctatagaaataagcccattagacacttgcyggggaaataaatatcaagaatgtactcagactctcatcagatacaacagcatgcctcttg

SEQ ID NO: 1540 - DNA, 121 bp, Gadus morhua
cagttcctttaggaatgaccaaaccgttgatctctacggttgccttggcgacacgctcgaracgcaaggcaagggggtaaagtctgagagactcgttgataacgctgtcaaggtattccat

SEQ ID NO: 1541 - DNA, 121 bp, Gadus morhua
cggaacatagtttttagcattcatcaggaaacatcatagtgcaataccattgtcaatacawccacaacagtgaagactaaatatattatgtacttagtaccggaaaatacatttttgattt

SEQ ID NO: 1542 - DNA, 121 bp, Gadus morhua
ccatcttctgtaaaacaacgttaatacggcgaagggttcacttgtaaactgggtgacttgrtaagatagatattttctagtattcagtaggagtgtttttttgctctacgctgctaacgga

SEQ ID NO: 1543 - DNA, 121 bp, Gadus morhua
aaaactatgaatcagattattgttatagagcctaaggatatgggtcatgacaaaatgaccwatttataaaaaagatgaaataaatacaatacaggcacatatgaaagtaaacatagcatgt

SEQ ID NO: 1544 - DNA, 121 bp, Gadus morhua
attcctctaatgtgagcctaatcgtttagcctccgtctgctccatcacttccccagtcctrttccgctagtctctgtctgcactcttccgtgctgaggacacctcatattcaatcattgta

SEQ ID NO: 1545 - DNA, 121 bp, Gadus morhua
gttacttcacagctcacacaaagcaatacccatctccactcaaactaagcacgatgtggyyctgtgcttatccttctgctttgatttaattggcacacaatgattacacgtctgcctggca

SEQ ID NO: 1546 - DNA, 121 bp, Gadus morhua
attaatatataaataataataagtcttaatcatctcacacaataattgtagcagcttaaayaccttcattactwaagtaatatagcttatagatcacatagcttactcctattgataatcg

SEQ ID NO: 1547 - DNA, 121 bp, Gadus morhua
catcttcataggactgtcatatccaacggcayagctaaagtcctttttatacatggctccmaccgatttcraggctgtccattagttcgctctctttaatcccctgaccctatagctcatc

SEQ ID NO: 1548 - DNA, 121 bp, Gadus morhua
tgtgcatgttgccaatggcattcatatgtaactcatatgtaaaatgaacattgttaaaackttattgatatttgtgtttttgtctattgttaagtaataaagattccactcgaaatctctt

SEQ ID NO: 1549 - DNA, 121 bp, Gadus morhua
agacagcaagtgggatagacaactttatcgattcaaagtgcaaaatcaaagctcctaaaawttttttaaggatggtaatgaagctgaggtgagcttattgcgatataatgcagcaataaac

SEQ ID NO: 1550 - DNA, 121 bp, Gadus morhua
ctacatcgggcctatgacacactggagactgcaggatgttttccaattcaagaagtggtcmttaaatactaggatatacttcagttacttttttacctcctcaatgcttaaagtgccactc

SEQ ID NO: 1551 - DNA, 121 bp, Gadus morhua
ctatcgcgcagttatgacaacagtggagttgaccgacatgaaataatattgactcaactawacattagattaatattttttggtaaagatttgtgttctcatttgagttactcaatatatg

SEQ ID NO: 1552 - DNA, 121 bp, Gadus morhua
gcctttctcctaattggtacaagcttagtctgctctatagcagtggtctcggattcacaamgtttggttggaaaatcagcggaaacagcaacatctgaggctggccctgagactgtagagt

SEQ ID NO: 1553 - DNA, 121 bp, Gadus morhua
aatctttgttcgttgatggcaccacaatagaggtgtcctgttttgttttttcagtctttcsttcagatgttttaatagtggtttctgctggttgttttgctgttgttctgcacactttggg

SEQ ID NO: 1554 - DNA, 121 bp, Gadus morhua
caaaaagaaaatttgttttgatttaaaaatatttaattagaaatctagtctagatattgtractttgaaaataccctaagaatcaagctgggtatctaagggtgtataaaatcatgtttat

SEQ ID NO: 1555 - DNA, 121 bp, Gadus morhua
cctaagaatcaagctgggtatctaagggtgtataaaatcatgtttatccaagctggtaaayaactggttatatcttctctgagcactgtttgttgcatttgcaagaggtccaatatgcaaa

SEQ ID NO: 1556 - DNA, 121 bp, Gadus morhua
ttgattaggtgatctggattaaccgagcaaaacaacagagggaatgagaaaccgtaaaacktcaaaccccacaaacacgcacaacttttcatttttgtgtgcatctcaggttatgaatgga

SEQ ID NO: 1557 - DNA, 121 bp, Gadus morhua
actaggttagataattagcagcagaagaggttagccagggcttgttagctgctaactagcrgcagaagttgtccgcaggggaaagttatcagctaactagttgcagaatacgtaacccggg

SEQ ID NO: 1558 - DNA, 121 bp, Gadus morhua
tacacccggaacatgatgtaacagctgtgttgggagtgttaacgttgtgctcagttaacgyattaagaggttcatccagcacagtttatttacatttataatatcaacaccatttcaccaa

SEQ ID NO: 1559 - DNA, 121 bp, Gadus morhua
ccttaacagagacagagcagatatgtttctaatatctgttgtagctatgctgaaaatattmaacttacctacatgtcctgcaaaacagtttaataaatatttcatcagagaagacaaaaac

SEQ ID NO: 1560 - DNA, 121 bp, Gadus morhua
tttgccaagcagacagagttccgtcttcctctgagtsacgatgcgctggtcctcagcccgyaggccagtggggtggcgggagaagatgaaggagtatccgtccaggcaggtgccgtcgcag

SEQ ID NO: 1561 - DNA, 121 bp, Gadus morhua
tgaaacccttaacctttattgttacagagtttccttttcatttgtgatggatggtctgagmataagcgaggttaagcaaggtgtattattacacatatatgccgatgaatgctttgtactc

SEQ ID NO: 1562 - DNA, 121 bp, Gadus morhua
tttataaatcataccatagctagaatcaagtaatgaatcaagtaattttattgtgagcccrctcctcctataaatacatgacttgaattcctgtatttgcaagtacaacaatacaatacca

SEQ ID NO: 1563 - DNA, 121 bp, Gadus morhua
aactcaaaaataggggaataaaatcagggggatacatttatttgttcatttcaacatcgcratctagactgagcgaatcacagaagtctcgcttcaatgtaacctcagccagagagtgaac

SEQ ID NO: 1564 - DNA, 121 bp, Gadus morhua
taccgagggctaaatggactggacattatggcatttaaatatgcataacagatcagtattytatcaaattattattttttcactactgctttttaactgtttgcaatatctttgatttatt

SEQ ID NO: 1565 - DNA, 121 bp, Gadus morhua
gcatttgacactaaggtatatgcttgtaggctacatctcgaaatatatctgagagaaagargaaagatttgcttagtttctaattaaaatgtcactactgtaggccgtggatggcatgcat

SEQ ID NO: 1566 - DNA, 121 bp, Gadus morhua
ttagtctaccaaagcatgcggtgtcattacacaacaatgacatttcaaattggcagccagratgatatttttgtaattttctatacaataacagtagaaatacatcaatgtcatagaaaac

SEQ ID NO: 1567 - DNA, 121 bp, Gadus morhua
cagcagagtgtgtatatatccacatggggatacaagtttaaataaaataaaaaatcttcaytcccatcaaagagttcttcacaagggattattaaaaaacaaaacaaaaatggttgagata

SEQ ID NO: 1568 - DNA, 121 bp, Gadus morhua
cgagagtggtagaacccccagagacacttctgagccggtactccatcagcacatctgtcarcttctgtgtcaccttcagaacaatctgggcatcgtcctcgttttctatccgaaaggtatc

SEQ ID NO: 1569 - DNA, 121 bp, Gadus morhua
atgaaacatcaaatatctttataaaggtcaaaaacagtcatgaaaaatgaatgaaaaacasctaccactgaatatttgatcacataggttaaattgtaatgcatttggttttgagcaaaga

SEQ ID NO: 1570 - DNA, 121 bp, Gadus morhua
atcaacacaaccttgactaagcctgcttagaagttagccaactctaaaaacctcaacactraacctaatttacacacattttaaaaattgcatctcatttgcttatttttttcttggatat

SEQ ID NO: 1571 - DNA, 121 bp, Gadus morhua
cagggtaatcataaataaatacaaacaaggaatgtttactgcaaaaaaaagaaaagaaatrcatacaaaaaaccaacaacattgtttagactggaatttcttttttttcctcccacaataa

SEQ ID NO: 1572 - DNA, 121 bp, Gadus morhua
gtattgcaggcagaaatggtgtgcatcaaaataagaaggcagagactgaaactatttgwcytatttcctatctctactcttacacactctttgaaggccgtggcataaccaacttcagccc

SEQ ID NO: 1573 - DNA, 121 bp, Gadus morhua
gaccattctctcccacgccttcttctgcctcttgccagtcttgatgactttgagcacctcygtctcgccctgagcgcgcaccttgggcaggggaacctcccatttaccagccttctctttc

SEQ ID NO: 1574 - DNA, 121 bp, Gadus morhua
taatttcattaacggattaacttgcttttgaaaaactaatacatatcatgctttcactccyaaataaatcaactttgaatcggtctttcatccttaataagttccttggtgacttcactgc

SEQ ID NO: 1575 - DNA, 121 bp, Gadus morhua
cactaaaaggacaagattaaaggagaggagaacctcaccgtaccattttcattagtgttaygtcttcctcatccttataaattcatatggaaattctaatttgattgtgaagaaaacaaga

SEQ ID NO: 1576 - DNA, 121 bp, Gadus morhua
aggcacatctgtaggtttttaccctggcttatrccacacgaaattgcctcatgtaagcctrtgtattggtaaagtacatcatttatatgcattgtctaacgtaatacgatactgttatcct

SEQ ID NO: 1577 - DNA, 121 bp, Gadus morhua
aaaggtaatcacagttattcttctgcgaaattccactgaatctagaaataattccacacaygctggctcattaaaaaacaaaatacaaaataagttagtcataacacttaattaatgctca

SEQ ID NO: 1578 - DNA, 121 bp, Gadus morhua
aggtwtgaggcatgttgggagaggggatttaatcaatttaataatgatgaaactaaagttsagccatttcgtagaatgtctggcgagtttttacaaatgtttaacaagacatattatttga

SEQ ID NO: 1579 - DNA, 121 bp, Gadus morhua
catagagacttccaaaaagcaccttgtaacccaaaataaaaccgcccgtttctttggtcakcaaattctatgcttgttaagattgtggcaggtatcacctgatgctcttcacttcaaccag

SEQ ID NO: 1580 - DNA, 121 bp, Gadus morhua
ggcaatggttgacatttttcttggacaaagcttggatccgcatcgtgttcgacagagaccwttcttactcgcagcttcccatcctcagcacatggcttccttgtaaccctgttcattcccg

SEQ ID NO: 1581 - DNA, 121 bp, Gadus morhua
aacaagtatcggcgtgtgcgactttctcctcaggagccagccggccgtcagctgtcttgamtgcacttcttggtcaaaggctccaggtatttgtcctgtcagtctgttgtactctcccagg

SEQ ID NO: 1582 - DNA, 121 bp, Gadus morhua
ttgtcataacaaaacaaaaagatccagtcaagttttcctatgattagtcagtgaaccaacrgagataagtcaggtatttccagttcggcagcaaaatactttgtcaaatcgtactgtcctc

SEQ ID NO: 1583 - DNA, 121 bp, Gadus morhua
atggtgatagaggtgcaacacagcacagtgtgtgtggtgaaccgtgatgaggaccattttkttcactgcagcagtacttctgtaacataatgacgtgatcatgaggtggtagaagtcatgg

SEQ ID NO: 1584 - DNA, 121 bp, Gadus morhua
aaactctaacaggaacattttcagtagcattcagctattccagtactattattgttttccrttattattcggaacttaccaatagttggtctggcctatagtccacaagacatgtagtggt

SEQ ID NO: 1585 - DNA, 121 bp, Gadus morhua
caagcttttttacaacacaaatactttttgaaaatagtaatgaccaattttaatagtttartcttcaacagccacaaaatgtatattttcagaatttacataaaatagtgttaatatctat

SEQ ID NO: 1586 - DNA, 121 bp, Gadus morhua
ctttattttgtcgatggcatggaacaattgtggttgttttgcagtttaaaaaaaagtcccycataatgacgattgcttatctattttccttgacaactcgatatggccagatcagaaggca

SEQ ID NO: 1587 - DNA, 121 bp, Gadus morhua
gaacttattaccagcaatatctgaaaatatcaattaaatacagagcacttataaattaatkaaccaaattaagtctaccctgtatagtgaccattccagccagttacgtgtggatcaccta

SEQ ID NO: 1588 - DNA, 121 bp, Gadus morhua
ggattttaaagggaatgctagtccaaaacttccagaaatattatataatcacaacaatttytctttactttaaacaaaaacaaaatgctacaataacgtcaggtatacatcacagaaagaa

SEQ ID NO: 1589 - DNA, 121 bp, Gadus morhua
cacatatctaacttgaattactatccagctataaagtaccaataattggggttgttgctcwgagagccttgtgtacaatcccaatgcttatagtgcagtgccgtcctacagacgacacttg

SEQ ID NO: 1590 - DNA, 121 bp, Gadus morhua
aaggggctatcaggacaaagaccttttctgtctgtctgtttgtttaacttcaaaaagctcrtactcatgaatatctagtaccagaagaattcaaccatatcttagatagattacaatgcca

SEQ ID NO: 1591 - DNA, 121 bp, Gadus morhua
atgtgtagataaaaggggcaatccccacaaataacaaaactaacgaacaaaaggggggggraaaaaggcattgcgtacatgcaggttatttttttctttacatagatacaagttataaaca

SEQ ID NO: 1592 - DNA, 121 bp, Gadus morhua
ctgcttgtctttcttgtgctccttgccaccttccttgtgtttcttgtctcccttgctcttrtcgtggtcctttgacttgtccttgcagtcagacttgtcctttgtgtcctttgtgccgaaa

SEQ ID NO: 1593 - DNA, 121 bp, Gadus morhua
gccacaaaccaggaatgtattaaaaaaggagtggctagctaggtaaatctaggaatctatrtgtatgcaccatacaaataatggccatctccttgagcaatagatatattactttagctgt

SEQ ID NO: 1594 - DNA, 121 bp, Gadus morhua
aacacatacgccaataccgatatactgtatctgtgatgggccaatatcggccgataaaatmagccaaccgatataggcggtacaggctctagtttaaactaataaccggacataatagtaa

SEQ ID NO: 1595 - DNA, 121 bp, Gadus morhua
cctataaaactgaaatggcaacagagatacccgaaacgaaccagatgttttttatgaatawaaaacccaaatcctacaattttacatgaaagtagttgctagtctctcaaatcagcttaat

SEQ ID NO: 1596 - DNA, 121 bp, Gadus morhua
gatgggcttgtctgctacttgtcaaactgtcttaaagaggcctgacacgatgtaatcttcrgcactgccatcaatgagccctgtcccatttactgtggatgaaccagcatgggacattttt

SEQ ID NO: 1597 - DNA, 121 bp, Gadus morhua
ttaacaaatatctgatgatctttggaaagaaggaatagtaaaatgtgttgtaactgattamccatgtattaatacaagccacaaagtaacttttctgtgttcaatacacaaatgtgtattg

SEQ ID NO: 1598 - DNA, 121 bp, Gadus morhua
cgtgtacaactcaaaagtatgtttagccaatgaggagccttcaacctctctctcctggctygttaataagcactcctacagaagacttcattgtgcccacaacgcgcgcacactcttgcac

SEQ ID NO: 1599 - DNA, 121 bp, Gadus morhua
actcctacagaagacttcattgtgcccacaacgcgcgcacactcttgcaccctctctctckctctctctctctccaatccgaaacactgttggtactgtttcastgcaaaaaataccgaga

SEQ ID NO: 1600 - DNA, 121 bp, Gadus morhua
tggcacaatctttaacaaaagtgatatttcctgtcatagataaaattaaaaaaaactaagraaagataaccaaaaaaaataacaaaggaaaaaacaaaacaaccaaccgaacgaaagaaaa

SEQ ID NO: 1601 - DNA, 121 bp, Gadus morhua
tcaaaatgaaggacagcaacatagaccggtatagacctccatatttaatctttaggacacwaaatattatctttttatcatctctaagtcaaatattctgatcaggagtacattttaatta

SEQ ID NO: 1602 - DNA, 121 bp, Gadus morhua
cgactgccccctgcccacggactattgacctcgtacagcatccattcgtcagcgcggaagktgttgtggaaccacatggcgtggtccaaggaagccattattttcacccttttagcgggat

SEQ ID NO: 1603 - DNA, 121 bp, Gadus morhua
tgcatgatgttcacagtttcacacctaaaagcacagcatgttaaacaaacgtaatattagygccatatttctggtcacgtatacattttcattcacttatcccccccaacaggaraggaca

SEQ ID NO: 1604 - DNA, 121 bp, Gadus morhua
gcgtgggcatatcacatacaaaacaaaaaggacagtgatgcaaggaggtaggcggtttcgkacaaataaccayctgagctgtttttccctgtataacccaaatctgcacctgtctccaggg

SEQ ID NO: 1605 - DNA, 121 bp, Gadus morhua
tcaaataaggcttataacaccagaggcattaagggtcagttcaccataggacaackyggaraggaatagacttggaaggcaaactgggctccatctgttacaactgctggatgggaaggcg

SEQ ID NO: 1606 - DNA, 121 bp, Gadus morhua
aatgcccaaaccagagatcatgcagcatgcaaggaaaatacaaaagcctatccaggcggayatggggtccctgctttacattgatctgaagggccagactctttcagtggttttgattatg

SEQ ID NO: 1607 - DNA, 121 bp, Gadus morhua
accatttgcaaggccaaattacaaataaataaggaaagagacacgacaggcagtctgaatsgggaagcccgtctcaacggggtgccactcacttacacaaaacgagagggatacagacccc

SEQ ID NO: 1608 - DNA, 121 bp, Gadus morhua
gcatccattcaactgacaaaactacttcaccttacaactgcttgattcagtctatgagaaratagcttcatttctgctacaagatgccgactggacacaaaacaaaaataacaaaacaatg

SEQ ID NO: 1609 - DNA, 121 bp, Gadus morhua
acrtccaggagtgaacacaaagatttctttcttctactggttagttaataactgcaaatawggtgaggggataacttctgaataataactgccatacagcagtacctcagatatccattgc

SEQ ID NO: 1610 - DNA, 121 bp, Gadus morhua
caggttcatatgaactggaactctttgtgacccattcagggaaacagcctttacactcacyagtggctcggttgtttgaatgaggaacagctgcattgcacatcccaccaaagcacrtcca

SEQ ID NO: 1611 - DNA, 121 bp, Gadus morhua
ggaggatgttacagagaggtgacagttctactaaataagccaaatatgaaaaaagaaaagraaaaaacggtatttgtccagctcaaaaaaataataaatgcaaattccccaccctgaaaat

SEQ ID NO: 1612 - DNA, 121 bp, Gadus morhua
acaggaaatgcgagcactttgaaagtcaacctaagggcgaagtttaataaaaaaataaaamtaaaaactaacttgaggtaagaaggacttgtaggctagggaaactgtagcctgctctcca

SEQ ID NO: 1613 - DNA, 121 bp, Gadus morhua
atgaaactacgtcaccaaacacatactagaatcatttacagctgggaggggtggaggggcrcttcactacgctgcggtagatctggattgggccgtgggaggagattttagtttagcttgt

SEQ ID NO: 1614 - DNA, 121 bp, Gadus morhua
attcgtgtataaaagtgaaaaagaaagagagtaggaaatcacaacgattgtcgacgtaccwaagtgtcacagcattcaatccaattacgaattcccagttccctttctgtaacattcacca

SEQ ID NO: 1615 - DNA, 121 bp, Gadus morhua
aactcccatgtacctacacatttctcaagcctttatattgctaacacgtatctcacgcagyctccagcaagtggctaaaggaaaagaaagcataatctaatccaaatgttgaagctctgga

SEQ ID NO: 1616 - DNA, 121 bp, Gadus morhua
agaaattttgtaaggggcacatcgttgttgtttttttggggggggggggggagaaagtaasaaaatgtagatatggcctatgagtatcactaaccatkttcagaaagcattattaggttta

SEQ ID NO: 1617 - DNA, 121 bp, Gadus morhua
tcactaaccatkttcagaaagcattattaggtttactcttctcagtagcacccacgttatkagccattgactgtaaacacatggagccatggtagcaagtggcaagttctatgacatacac

SEQ ID NO: 1618 - DNA, 121 bp, Gadus morhua
gtcaaccacattgaatactttccattgtgttatattaaatccaaagctagacaacagaagsgattctgggatatcctaatcgacctcctccatcctggatgtgtcttcgtctccttccaga

SEQ ID NO: 1619 - DNA, 121 bp, Gadus morhua
tgaaacaaaaaacaaaatcaaatatctctcgagttctttcgaggacaggagcaaacaaccracgctgaagtctcaggtgtgtggccataccaatactgctacagttaccgttcttcataaa

SEQ ID NO: 1620 - DNA, 121 bp, Gadus morhua
aagaaagactgtcaaatgaatattgacaattaattgaaaagtattttacatttcttgtgtwgttgtagtggttcaacagttacacaattttctgatctgtccatttatcattgagcaagga

SEQ ID NO: 1621 - DNA, 121 bp, Gadus morhua
cccaaaatgaaagatggatcgtagcaccaacagttctacaagagctgggagggccaactgkgtaccaacacaggatgccaggctacttctatccacagattaaaccacaaggaaaataatt

SEQ ID NO: 1622 - DNA, 121 bp, Gadus morhua
aaagggtaccatttatccagccaccagaccaagtaggcctrtgtaggctgctcaaagagtkcgataaatagacccatctaacgtaaactatttggttcagaggtaatttaatgagtcatct

SEQ ID NO: 1623 - DNA, 121 bp, Gadus morhua
agaagaaggcagtgatgggcttgagcagagctttaagcacattgctcgagttacggctaakctcggaatttatggctcctggatggaggctgtagcaggtgactttagtgccctggagtct

SEQ ID NO: 1624 - DNA, 121 bp, Gadus morhua
tctaaaaggtacaaaacacacaaaaagaccaaaaataagatacaactacatcagagcctgygtctcaatactttacagacgcctactggcaatggaactagtctacagtcacgtctcaaca

SEQ ID NO: 1625 - DNA, 121 bp, Gadus morhua
caagctacaacaccttggcaattccgcaccctgtatctacggtcaaacaaaaatcaaaacrcttctttagtaccaagcctttacatactttcacataaaaagtgtgcaaatgccattcaca

SEQ ID NO: 1626 - DNA, 121 bp, Gadus morhua
tttcctgcacaacaaattacccttgcagaaaactgatttcacattccattcmtttattttytgttaagctattgcatttgtggcaaatggagtatttacatctctgtccttaaaggtcatc

SEQ ID NO: 1627 - DNA, 121 bp, Gadus morhua
acatttgtgcagtttggccataacaaataaagattttagaaaatcaaccaatgtacatgamaaatgaagtagaacagacaaatgagtacatcaatttcctgatgtccgttaagtagattaa

SEQ ID NO: 1628 - DNA, 121 bp, Gadus morhua
ttgtattttcttatttcgtttgcttgtatcagtattgatccatgtcttgtttatgtttttwaattatcatctatcagtgcgattgtataccagtgcagctactgggtccaaagtaaagaaa

SEQ ID NO: 1629 - DNA, 121 bp, Gadus morhua
gagaacacaagcatgactgcattagtttctttttagtgacttcagagtgatacacatacaraacatcaacacagttcacctgaaaataaagtgaaacacatggtatttgcagattcagtca

SEQ ID NO: 1630 - DNA, 121 bp, Gadus morhua
cagaggacagttgaaatgaagacttacttaaaactatttgcctcgaccattttttttaatmtttttcgtcaacccaagcatacaatggacatccatagatactgtaataccattttgtaac

SEQ ID NO: 1631 - DNA, 121 bp, Gadus morhua
cacacacacaagcaaggtaacacagtcacggtcaagatcattcgttggcatcatccgacarctttgcgcacacattcttaatggtcactctctcgcatatgtaggtatttccatcaggatt

SEQ ID NO: 1632 - DNA, 121 bp, Gadus morhua
aaaaatccatcttactcatgtattaaagataatgcatcctcattattggcagagatccacrggcttctgcaaaatgcagaatggaaacaccttcttagttgtgctgctagtgtactaactg

SEQ ID NO: 1633 - DNA, 121 bp, Gadus morhua
tcaatcaaatccattcacactctttctctgccaatagcaactcctggcccccagcgagagyttctcatctggaccatcaaaaactaactgtggtcagatcaaagcattggttccaactgag

SEQ ID NO: 1634 - DNA, 121 bp, Gadus morhua
ttttggagtagcataatactagtgaggccatacctcaactagcagcattgctgtaaatacwtttatcaaagtaaagttgaccaaattgtcaatgcagttaccaacatacatggcatccaaa

SEQ ID NO: 1635 - DNA, 121 bp, Gadus morhua
attcttctgtcaaagcacgaggcggctaatcataaaacaagataaaatataaacaattccmaaacatacatttgtaacagaaaaaaaacaaaaacgacaaacagaacaatgtagttgaaat

SEQ ID NO: 1636 - DNA, 121 bp, Gadus morhua
cacctttgtaaatattataccatgttcttttgatggaccttaaaagcagtagcgaggtggycatggttcgacaactgcgggggtgtagttgggtggagagccatgcctctgtgtactgcag

SEQ ID NO: 1637 - DNA, 121 bp, Gadus morhua
ttggcaatcttcttcttgcccatggtggtaggtcaccttgcgggggtaccggtcgatgccsgagacaagcgcgtggctgtagggtcggtacggcggtaccgtcatcgatgttcttgaacga

SEQ ID NO: 1638 - DNA, 121 bp, Gadus morhua
agtaggctccaacagttgaatcaatccatgttatcatggtaacgatcatgttagccttttwaaaatgaaaaataaatgtcttgtatcccacagccctacaataaagtacaatttgtttgat

SEQ ID NO: 1639 - DNA, 121 bp, Gadus morhua
cagatcacatcctatagtgcaaagatccgcaacccagcggtgggagccagttctgttccamagccgccaacttagtcctttcttggttgaagtctttctccataatttgatcccacgggta

SEQ ID NO: 1640 - DNA, 121 bp, Gadus morhua
atttcgcattcacagcggtctgatctctgacagacaaaatggtcatttgttgaccattgargatactcctaattcagtgatgcttcaacagaccataacaattagtggtactacagaggga

SEQ ID NO: 1641 - DNA, 121 bp, Gadus morhua
cggtgaccctcgttattcagagttatttggcacaggttgagcacatcgacgtctctttccktcccgcctcagtgtcttccaggcgcccgcataatgaatcattcccaacagagatccattt

SEQ ID NO: 1642 - DNA, 121 bp, Gadus morhua
gagaaaaagaaagaattaaaaaaagaggaacattttggaataatactttcttttacatttycggatggatacttagaacccactgctatagaataaactatagaacgagaaaaggccgaga

SEQ ID NO: 1643 - DNA, 121 bp, Gadus morhua
ggtcctatcgtaggacaccatggcaacaattgaggctggatccacggagttgtggctgacrcggcaggtctacaccgacactttggcagccatcgtggaacactgaatcaccctggccccc

SEQ ID NO: 1644 - DNA, 121 bp, Gadus morhua
tcttggtgaccgcgtcggtggctatgtagccactccccaggaagtaggcaaggttgtctgycaggtggctcttcccccgcgtcttcctgaactcctcaacagcgttcttgatcctcttgtc

SEQ ID NO: 1645 - DNA, 121 bp, Gadus morhua
taatctagtactattgctattaggtcactccggaaaacaccacacagaataaaacctcttsaaagaaattctctataataccctattctctaattattctaaataaatgaatactaaccgt

SEQ ID NO: 1646 - DNA, 121 bp, Gadus morhua
cattgaggctcttagtgtccattaagtcaacggtctcagacctaattaaacactatgatartcactgataatgattagcttgtaactgatccacagacagaagagacaccttgttgccttg

SEQ ID NO: 1647 - DNA, 121 bp, Gadus morhua
ttttattgtgtttttggaaaactgttaaggaataaacaaactacattaatggaaatgtgtygcaaggttgtaataacacagaaaaacaagttaacttgaaataaacgaacatacatgtaat

SEQ ID NO: 1648 - DNA, 121 bp, Gadus morhua
ctggatcttctgtacaaactaggacttgcactgattttctaaaaattctaaaagtcagcayatttacaggactggtcaggaaaaaaaataaaaacacattctcacaatcatcctttattta

SEQ ID NO: 1649 - DNA, 121 bp, Gadus morhua
gggtttagtgcgcccagtcttctcctggagctgggacaccttcagagcgatgtccaccagyggtgccagcatcacctgtgggtcctggtagatcttctgggggtccttctcatagctgtct

SEQ ID NO: 1650 - DNA, 121 bp, Gadus morhua
aaatatttcataagacatataccatggtgctagtttgattgtaaaacagaattgaagtgayacatcatctgaaataaaacaatcaaaggaaagaggttaatcagtacacatggaaggatgt

SEQ ID NO: 1651 - DNA, 121 bp, Gadus morhua
atcacagatggcgttacttcactgttcactagttaaacgtctagactattgcctgaatgtkgagtgattacagatcagggtactgaagctagggaggggggggacagtagttttgaagact

SEQ ID NO: 1652 - DNA, 121 bp, Gadus morhua
ttaatgtgaaacatttacatttaggcttctgttcacgtagactgttctccgaaatcgttgmttttaaacttttaaaagtgttaagacaccattccactaaacgaatcgtaggcctatagta

SEQ ID NO: 1653 - DNA, 121 bp, Gadus morhua
tctgtgtcataatatccagaattaaaaatactcctaaaggtgaggtcggtcccacccagtrcctcgttgacctaattccctgccaaacttgaaatgaacgactagggggagattctgcata

SEQ ID NO: 1654 - DNA, 121 bp, Gadus morhua
gtggaactccatcacaactacgacatcgaagtcggatcatcatgagccatgaaataatatrcatttttactttaacaaattaaatgcttttattaatttatgtcagaaaggccataacaat

SEQ ID NO: 1655 - DNA, 121 bp, Gadus morhua
ccatctttataaactcatatggcttgttaaaaatagtagcaggattactaatataccaatmcaatttcaatctctttccatcaagtagaaacaaagcaataaagtgtattttatataaggt

SEQ ID NO: 1656 - DNA, 121 bp, Gadus morhua
aatcattttgggggaatacaattaagaaaaaaataaactgcattttcaaaatcataatttygtttaaagaaataccagggcctttttttgtctaattgtatgcgtgtcctcgggggaaatt

SEQ ID NO: 1657 - DNA, 121 bp, Gadus morhua
aactaacactgaatccatgtctgcatccttgtggtattttccaacatgttttkgtattgamgacctccgcaaatgaactggcgagtcaaggggcaagtctactgatgatgagtttttagtc

SEQ ID NO: 1658 - DNA, 121 bp, Gadus morhua
tatagccactgccgacatccagtgttctgtgttcttcatatatgtcctattataatattgwttaactcaatattaatcgttacttccatatcaacaaattaaaatttgcatagtgggtaaa

SEQ ID NO: 1659 - DNA, 121 bp, Gadus morhua
gatcttccatggatcaattgattcacaagacggtcagaagtgcctttgtgcataggttatwttgaacttccctcatagtgcttttagggcagataggatgccctcctattggaaaccaaag

SEQ ID NO: 1660 - DNA, 121 bp, Gadus morhua
cagcttcttctccatcgccaccatcagcttgacaccatcaaccaccatctggacctgatcsacctcggaggagcccagacgatcggcgttggagatgtcgaacacaccgcccacggaggct

SEQ ID NO: 1661 - DNA, 121 bp, Gadus morhua
tcacatataaacattgtcatacaataaaataaaataatagataagtaaaagaaaaacatakgcaaagaaatgggtaaaatagaaaaaggcattttagtattaaaatagaaaataaatgcaa

SEQ ID NO: 1662 - DNA, 121 bp, Gadus morhua
ggtgaagtaccaaggtgtggggcatcaggatttacaacaaaaccacatggatacactagaytacctgtgagctttgtgtactgtgttgctgctatgggctcttgttctacacctcttttca

SEQ ID NO: 1663 - DNA, 121 bp, Gadus morhua
ggggtttttctccacaaagaagttgttcttggtgaagcgcttgatgcagaatatcaggtasgggggcagtttggtcagctggaatttcttgaggaaattctctttgtatgttttgtactcc

SEQ ID NO: 1664 - DNA, 121 bp, Gadus morhua
ccaaagtatcgttcaagggggttaaacctatttgtattgccttgtctacaaaaaggaaaayaggtatatccaggtaatgagcaatcacccagacccctgggagtgaacgagtccaagatat

SEQ ID NO: 1665 - DNA, 121 bp, Gadus morhua
agatatttgctgtcaatattcaagcactatgttacactcgatattacttgatttcttactwtaatgataagccttttgaaagagcattgctttgtacacagcgggcaaagtcaaaaaccaa

SEQ ID NO: 1666 - DNA, 121 bp, Gadus morhua
ccctcaacctgttccaagagcattttccaagagttcaaaatagttgttttcttctggtaasagggttaccattacattttggtattgtgtaaagtgctgaaatacagagttcaatataatt

SEQ ID NO: 1667 - DNA, 121 bp, Gadus morhua
ctacccaaagaacatccaaacacgaaagccgcaatgcatcctgggatatggcacacacatmaatttaacatcctttggttaacctctacacattcaaatagccaacagcgtttctcaggat

SEQ ID NO: 1668 - DNA, 121 bp, Gadus morhua
ctgctctgccccttcatatattataaatcagtatgtgcttcattcaaaataagctcattayataaattaaccactgttcacactctgagataggcctacattgtgacaataaataaaccac

SEQ ID NO: 1669 - DNA, 121 bp, Gadus morhua
gcagatgcttgctgggaaagacctgttgaaattgcttcatcagcagacccctgatggcagygaggttccggccactgagtccagcatccttcatagagctatatctggtagccagaaccaa

SEQ ID NO: 1670 - DNA, 121 bp, Gadus morhua
atgttagcgccgacgtttcaaaggcctcccattcccccaactagtggaggagccttgaacrctgctggcctgttcctctggagtgagtgctgggaggcaggcagtcgtggaggaactcctt

SEQ ID NO: 1671 - DNA, 121 bp, Gadus morhua
gccgatgggtttgatgtcgaacatgaacaaccatgaaagtctttgttatcatgtttgcytytcaatgcgtttactttgaaaaatgacatcattaatcagcacaaagaccttgaagacacac

SEQ ID NO: 1672 - DNA, 121 bp, Gadus morhua
tcttaaaaagtttcttccaaaagatttgcacaggatatttggtggctgtgactgcgggcakttgacatgttcgcagggatttgatgatgaaaacagcaaatggaatttgaacaaattttaa

SEQ ID NO: 1673 - DNA, 121 bp, Gadus morhua
ggacagaggacaaaaacaaatcattcttgactacagccaattataaagatacagtaaaatrtcacaaactcatgagataagacatgaaacaggcagaagtgtaatttatagcactcagaat

SEQ ID NO: 1674 - DNA, 121 bp, Gadus morhua
aacctaagagcgaaactgagaacataactgaaactttcgacagttgtaaaatcagctaaaktatgagaaaattatataaatatgtttctggctgaaaaaccctttattgaatgaacaatac

SEQ ID NO: 1675 - DNA, 121 bp, Gadus morhua
aaggtggagtatatgtgggcgggggggaaatggcaaaatgcacaggagtaacacagaagakacattcaaacactagtctcaatgtgtaatcctgttctacacttgycaacagaatcatttc

SEQ ID NO: 1676 - DNA, 121 bp, Gadus morhua
tttccatggggcaaatgcattcaatcaatgactggatttagatcttcccgttttaacatcmaggtattctgatagggcgcaagacagtttcgattgataaattaggatattaagaacaatt

SEQ ID NO: 1677 - DNA, 121 bp, Gadus morhua
aagtgaacctctagcacaggttaacagagttagccctgggatatccaactgccagtgtgayactttcaataccgtcgtctatagaccaatactacagagcctagggctgtagatgatttca

SEQ ID NO: 1678 - DNA, 121 bp, Gadus morhua
cacagtaagaacgccatgagaactcagcagattttatgagaggcttctccgaggctaaatrcagcaacagacatttggccaggctccacggagccagatcactaacaactccccgacaact

SEQ ID NO: 1679 - DNA, 121 bp, Gadus morhua
tggtacactaatccracctgtgacaccaagtctagcctattggatgacttattatataatrcaggcggcaacaaatacattttcccgttgtaatctactgtagctgctggcagtggtacga

SEQ ID NO: 1680 - DNA, 121 bp, Gadus morhua
gtggtaggcatttaaaagggctacaagataaacatttattatccattttaaagtgtttatratgtgtagtagatcctttgatttcatatttaatgcataaaaatgtaattgggggtgcatt

SEQ ID NO: 1681 - DNA, 121 bp, Gadus morhua
aaaagtttttctctccatctcttcacaaattaaaatccattcaaataatgtctaaagtttmattttgttccaaattaattacatctgtaaccattgatataaggatcatgtctcatcttat

SEQ ID NO: 1682 - DNA, 121 bp, Gadus morhua
aatatgatatattccttccttttatgagtagaaaacttttaaaagaattagtcgaaaggcrcaattttttacaatatatacacatttcgatctaaattataaatatatagaaaaacaaaaa

SEQ ID NO: 1683 - DNA, 121 bp, Gadus morhua
cgttcttaaaaatgtagtattttgtctcagtgtcgttccacatccaagacgtttaaagctytgactctgacgtcaaacttaaagcaacagagaggagagcctttgtttactcaagagaata

SEQ ID NO: 1684 - DNA, 121 bp, Gadus morhua
tcaaaccatttgtgccyatttttacatttttattctctgggtcaaattactttatatttamaattgaagtgaagttgctaaattactttttatctcacttcttaggaacaagtccctgatg

SEQ ID NO: 1685 - DNA, 121 bp, Gadus morhua
atacacgtatcagtccttttattttagagagctctaaatgtatctaggacgcttaaggacrctcatggttactatcaaaactgtaaataagtctttattgagattttcgattcatttgtat

SEQ ID NO: 1686 - DNA, 121 bp, Gadus morhua
ctaaacgcgtcatatactttgtccaagcgtgcgacaaaataacaaaccgtggccccacccwaccaatcgcaccgtttacaatcgatctacacactgctggtacccaggggccagtacagca

SEQ ID NO: 1687 - DNA, 121 bp, Gadus morhua
catttctggctgaccgcttgattgttctgtgtttgtgcaatgccgactccaggtgttgacygagtgctttctccccatccaatgtggtatcacaagcgaggcagtcatagagactcccaga

SEQ ID NO: 1688 - DNA, 121 bp, Gadus morhua
atcaatgtcttccaacacattaaaccatttaaaatccttaattttgtatcaagacgttggycttacaggtggatggtgagtcactgacatattaatcgataaaacaacaataaataaacgt

SEQ ID NO: 1689 - DNA, 121 bp, Gadus morhua
tgagaaaacactaaactactttccaaaagccttccgttcttttatagacctagaaacatgrcaagaaatacaccctagcataactttaaccagaccacaaaaaaaagctctttatgcccca

SEQ ID NO: 1690 - DNA, 121 bp, Gadus morhua
tgctccattatagttcccacccgccgctgcaaagaacatctaggctcaagcttcgcactgsatgacaacccttcctgctgtgtttctggcggtgcaaatgtactctccctgctgggctgat

SEQ ID NO: 1691 - DNA, 121 bp, Gadus morhua
aaatatgtataaacacggcaaataacatctagccacactgtcatggcaccatcatagaccraacgcaatcacaatttctgaccggctctaattgataccaagtgagttcaggtgctttata

SEQ ID NO: 1692 - DNA, 121 bp, Gadus morhua
tttactaaattttgaacctggacttgggccgaattaattctggaataagtgaggcaaarcrgtgcatttctttttttccccactactgtaacagaccatgaggaagggtaggcctatgcca

SEQ ID NO: 1693 - DNA, 121 bp, Gadus morhua
cacaaacggggtttgaatgcttcccctattagaggtatttaagaaaaatacaaaaacagcyggaaaagtcagcttcgcagatcaggcagacatgacaaagtggaacgaatcaggcactgcc

SEQ ID NO: 1694 - DNA, 121 bp, Gadus morhua
ttaaccttatatctttgattaaatatattaatatgaatttatccgtcacacccaaaggcawggaaaatactaaatgtttaaatttgttcaaggaaattaaatcaagcaactgccagagagg

SEQ ID NO: 1695 - DNA, 121 bp, Gadus morhua
tttataaaaaaaacatcttatattaaactataaatgaataatgtgttgacgcattatttgwattaattgttgaccaattagcatccattcatctggcttaagtcgcttagtccatgtcaaa

SEQ ID NO: 1696 - DNA, 121 bp, Gadus morhua
gtggatgtgggggtcagtcggtcagactaatgtttttattcctttcaaaattacaaaaatkatatgttgttctagtttgctcttgtcttgcatagtcctgtagctagccggttggaaagtt

SEQ ID NO: 1697 - DNA, 121 bp, Gadus morhua
tggaatcataaatggtttgtgtggtggttgtaaaactgtagcagagtgtcaaattatttgyccgcaacggaaattgtacacattttcaaaattaaaaggcgttaaacaccaattccttatc

SEQ ID NO: 1698 - DNA, 121 bp, Gadus morhua
aaataaatgtgagacaataaataatcccatatattcctagtttataacacttgcgtaaatmaaacattcgggatcttcatacatactattttactatgcacgtttaaatattcaaattgaa

SEQ ID NO: 1699 - DNA, 121 bp, Gadus morhua
ttacaaaagatttgtttagttaatttaaaattgtggcttattgcctttaccaagtaacttyctctgagaacaaatgtgctatattcttaataggttgaaatgtaaaagaaaccaataaggt

SEQ ID NO: 1700 - DNA, 121 bp, Gadus morhua
tttcaaagatttgcctcttatctcacttcacagtgttagaattactcaatgtayagtttaycgaagttcacgattaaaaaatgacattaataggcaacagtaacatgtaccaaatttcatc

SEQ ID NO: 1701 - DNA, 121 bp, Gadus morhua
gttgacttaagttcatgtctattgactcagctcaggcgaattcaggtcaataaagaataamtaaattcatagcacagtcattaaaaggtgctggcaaataaagcaaacgtatatcaaaaaa

SEQ ID NO: 1702 - DNA, 121 bp, Gadus morhua
actccttcaatgtttttcagaagctctttctgtcaatgtgaacgttaagaaagatgaatamatgtaaaccaggtattgtctaaatcaaaaattcaccaggtaaacgcgttggctgatgttt

SEQ ID NO: 1703 - DNA, 121 bp, Gadus morhua
caaatctgaatttattccactacgtacaaaccatatcaaagaagaaaagtacactttggamacaaaggtaaggtgtgcaattttgagacaaatcaatcaaatatatatttaaacatatttg

SEQ ID NO: 1704 - DNA, 121 bp, Gadus morhua
gtagagaaaaaaaaatggatgcatagggctctgyaacagtgagctgcagaacatgcagtcyttcgatggcctttcgtgtcactgcatcgaaaggcatctcgaaacgagcgtgagggctggg

SEQ ID NO: 1705 - DNA, 121 bp, Gadus morhua
cgtccgattttcgccgataattttttcgccaaatttttttattattttttcttacttgttytacctcacctgtttttactatttgttaaatatagttttttatattgaagttcaataaatg

SEQ ID NO: 1706 - DNA, 121 bp, Gadus morhua
gtatttctatatcattgtccattcatctggcaagtggacagtcctccctggatggcagtcytgttactcaaaactcaagttgtcgccaaaatctattttttttccgcagcatctgcaaagg

SEQ ID NO: 1707 - DNA, 121 bp, Gadus morhua
atgaccacatgatataaaatgctagcaaatttggtgaaacaaggttagagagaatatagtrcatatttgtctataggaccataaatcacaaatgtggaaaaaaaggaaagaaatataaatc

SEQ ID NO: 1708 - DNA, 121 bp, Gadus morhua
ccaaggttaataagtcaggatcaatgtacggttgtgatcggttgtggaaaatgtatcttastttgtctctagaattgcaatatatctgctgctctaaaaagtaaaatgtcctttatacatt

SEQ ID NO: 1709 - DNA, 121 bp, Gadus morhua
aatttgcactacaattggatttaacatctacaacagaaaattagttttcaaacatttgtcmattgaagcctaaattatataaggcattccatttctctatacgagaaggtgccaaaaatac

SEQ ID NO: 1710 - DNA, 121 bp, Gadus morhua
ccatatcattccttacttggattggttaatcaaaccctttagtcatttagaactagttttwagtaaatatatttaactgaattctgaagtatttcattcatcatctatcaaaactgaaatc

SEQ ID NO: 1711 - DNA, 121 bp, Gadus morhua
ggtcttgagtgcctcttccagatcaccacacttgagttcagacacttcggcgcgctcctckgctctctccagctccccctccaggatgaccagtttacgggccaccttcttcatatttgcg

SEQ ID NO: 1712 - DNA, 121 bp, Gadus morhua
gagctgttttattagttaagactgatgtaacagagaaaggttaatttgtctcatgaatgcmttgaaggaatatcaaaaaatatattcacggaaggtgatggttaaacaaaaccaatagatg

SEQ ID NO: 1713 - DNA, 121 bp, Gadus morhua
tttctagcctttttattttatttaatgcgagactatgaagaccagtagcggggtaagcccycctaaaggtcacgacctcctaaccctagccctcttcagggcaaggaaaaactccccagta

SEQ ID NO: 1714 - DNA, 121 bp, Gadus morhua
aggatcgcagaagaggggtccccctcccaggrwcggttaggagtcttatgcacccgggatkgttcggagtgtgattgagtgtggaatcggaggctaattggtgtttagcatcgaaatatct

SEQ ID NO: 1715 - DNA, 121 bp, Gadus morhua
atttgtttgcatgtcgttggatttctttctccaccaaagcttgatgcccacagaagttacktccttaaataattagattcaattgaaccctgaccagaaaaaaatccctcatgatccaaca

SEQ ID NO: 1716 - DNA, 121 bp, Gadus morhua
aacattgagaataaaagtcaatgcgatatgaagcaaaaacaggctgagagggttcaaacaygaatcaggtgacttataaataataatataccaagtgttttttagttgtcaattattgcat

SEQ ID NO: 1717 - DNA, 121 bp, Gadus morhua
aacgtcttttcccatagaacaacaggtttggctgggatagactaagctggcaccagtgccytccatacacctgttgggcctgcttctgttcccatacagcactgagctaacggactggaac

SEQ ID NO: 1718 - DNA, 121 bp, Gadus morhua
tgcccggtatgtcttcataacaggacttgatcctgtctatgaccttcgtcaggatgtctgkacttttcctccaatgcctgccttggcaaacggaagctctcaggcactgagtgcaatgagt

SEQ ID NO: 1719 - DNA, 121 bp, Gadus morhua
catttcactctcaattgggacatttcagtgcacgtttattcaaaactagaatcaagactakaaaataaaaatggaaagtcaaatttacaggcatttttttcacctccccacacccttgcca

SEQ ID NO: 1720 - DNA, 121 bp, Gadus morhua
ttcgaggacacctttcaatctgcagacgtctgttgcctccccctctgcgacatcggattcmgcctgactgcagccagacagttccagcatcctggcgatccccgaacctcgtatcggctcc

SEQ ID NO: 1721 - DNA, 121 bp, Gadus morhua
accctggtagaacctggacaggaggtcggcaggtcgttggttctccgtctcatggaagtarcgcatgatgtgggtcttctgcttccacaccttgatggtctcctctagcyccatcttcccc

SEQ ID NO: 1722 - DNA, 121 bp, Gadus morhua
ctttccttctctgccatcactagggacaaagtgttgggtgaatcctgcaggtgaaagtccsctccgccaccttccttaactatagcgcataaagaaatgtcaagcactttagaaagcaggt

SEQ ID NO: 1723 - DNA, 121 bp, Gadus morhua
ggggaacttcttctggatcagttgaatgaaattaaccaggattccagtggcttggtcaatrtgctcctcactgttccaagctcctctcgggttcgtggtatctcttatcaacctgcatcag

SEQ ID NO: 1724 - DNA, 121 bp, Gadus morhua
ataatgtaaagataatgcaaggatataggataagtaactatttgaacaggtcagtttatakacacgcatactggagttacaattgtgaccacctttaaagttgtatgtggcacaaatgtag

SEQ ID NO: 1725 - DNA, 121 bp, Gadus morhua
acctccttttttccaaatctcacaactttccccataatgagataaacattattttcagaawtattttctttctaaaataaatatgtattctttcttcatctgtatagcacaatcatgatgt

SEQ ID NO: 1726 - DNA, 121 bp, Gadus morhua
aaaagcctttagaagagtgagttatgatcacactgaagactaaccctctgttaaactattyagtaagaaataaccttctgtagtggattcagagatcccatcggtggtagtgagggcaaca

SEQ ID NO: 1727 - DNA, 121 bp, Gadus morhua
gggccagacacagatgcatcagctctctttggttctcagcatggagagaaaacgaatcgtyttgaaggggatcagtaaaacgttgttcacaactatcgcttcctactctatgcacactctt

SEQ ID NO: 1728 - DNA, 121 bp, Gadus morhua
tacatttaaggtttctttaatttattttattccaaaataattaagaatgtcatccagggaraaggctatttattgtaaaatgtgaatttattaaaagcttgaatccaaaggcaaagccagt

SEQ ID NO: 1729 - DNA, 121 bp, Gadus morhua
gttatcaataaaaaatcatttgaacaaggcaatccgatgcacttcaccatgttgataagakaattaaaatgagaagaattatgggacaaaaaaaatcaagggatatttagcatagaaaaat

SEQ ID NO: 1730 - DNA, 121 bp, Gadus morhua
gaattatgggacaaaaaaaatcaagggatatttagcatagaaaaataattcgcgattaatygtgagttaactatgacattaatgcgattaatcacgattaaatattttaatcgcttgacag

SEQ ID NO: 1731 - DNA, 121 bp, Gadus morhua
catctgcaaaatacagatgataaatcaattcctacaatcacacctacagacacactggtaraaaagaaaactaaaaagaaaagcatgcatcaactggcacagaggtaacatagaaacagat

SEQ ID NO: 1732 - DNA, 121 bp, Gadus morhua
catactcatagagtagaacatagctcttaaccataaaataaagcaaataaaatgaaatgamtatccatttgaaatatttatggaaaaaatcttgaggacttttaatttgaaagaaataacc

SEQ ID NO: 1733 - DNA, 121 bp, Gadus morhua
gtgagggaaatacagcttgtgttcctaaaatacgtaacagtccctccttggtcatcttagrtgaccatacaataatattttagatcataaacaccatttaccacaccgaaaacatagtcaa

SEQ ID NO: 1734 - DNA, 121 bp, Gadus morhua
tcacaattcttttattccatgatcacatgtccataacaattgatttaatcaataaagcaamcggtaaagcaaacttgaaaaaacatttgccatacagaacaaaagttaaaatagctgcttg

SEQ ID NO: 1735 - DNA, 121 bp, Gadus morhua
tcacatgcgcactttccgtygtggacctcttccctggccagctggacaactctgccgaccytggaggcgatacagaggtacttgaagaagcgctggtgggccgaccagaactggccccaca

SEQ ID NO: 1736 - DNA, 121 bp, Gadus morhua
ctttgcaaaagttggtttcaaagcaagcacaaataggacactatcccaaaatgatctagcratgtaaaatcaagcagctttaccaaaaaactacaagttttaaagcagccttcccttgcca

SEQ ID NO: 1737 - DNA, 121 bp, Gadus morhua
aaagaacaacgtatcacaatgttcgccaacaatgaaaaaatatacctgccactaattttayggacctcatttttgccttagtattgttttaacaaataaatatttgcccctcaaggattaa

SEQ ID NO: 1738 - DNA, 121 bp, Gadus morhua
cactactaggccaatgtccggattcaacttggtcagaatgacagcgaggtcaactttgacraacattaaaatgtctgacatttaattttatacatttctggtcatgttatttatcaggaag

SEQ ID NO: 1739 - DNA, 121 bp, Gadus morhua
cacagtgcatctagtgaaatattgttgcatagaagtgttgagtgtatggtaaaggtgactwtaaatcaacagtttagtacacgtctccaccaccatagtgagtcccctacgtagaggccca

SEQ ID NO: 1740 - DNA, 121 bp, Gadus morhua
tacgagaactatagaacactgagcgttaagaggttaccggccgctacatcatccatgaccytgcagtgctccaacccttcaaaataccactttcaacgctgttcaggatgtcagtctacaa

SEQ ID NO: 1741 - DNA, 121 bp, Gadus morhua
aagtatccgtctgtcacgcagcatttccacaccttcattgaacttaaaggaacccctggaycggcgatgcaccggacrcacgcaagccttcagaccccgcacacaaacaaagctcgagtca

SEQ ID NO: 1742 - DNA, 121 bp, Gadus morhua
cagtatttccacaaccttcattgaacttaaaggaacccctggatcggcgatgcaccgcacrcacgcaagccttcagaaccccgcacacaaacaaagctcgagtcatcatcatcaggagttt

SEQ ID NO: 1743 - DNA, 121 bp, Gadus morhua
tttatttttgcaatcaaatcctgatcggtcaaacacgacatgccaaacwgccattcaatasaacccgccccgtgttaaggcagtacccatcccagacagttaagtgcttctttttttaggc

SEQ ID NO: 1744 - DNA, 121 bp, Gadus morhua
aacattatctggaacggtaagaaaggcgtatagagagagacagaccgatacagaccgagaracagaccgatcaggcctttactgccgggttcccagatggcccaactgggagcaacagcct

SEQ ID NO: 1745 - DNA, 121 bp, Gadus morhua
ttttaagtcggtgctatggttaagtgcttgtgccctttaagcaaaaagagaggttgttttyctttttatcatacagcgtttatatacagcgtctatacatcactaacataactctggtggc

SEQ ID NO: 1746 - DNA, 121 bp, Gadus morhua
acccttcccgtcaaagatagagttgaacatgcccatcaatgcagtgaagcagaagccgatktgcgaacatggatttcatgcgaaccatgggacaagtctcgattgttgttcttcagtttct

SEQ ID NO: 1747 - DNA, 121 bp, Gadus morhua
ctgggaggttgggtcgttatattgaggcccaatattaaaagggaatagtgttgccttttargctgttggactaaccgataaacataacatgtcgaatgttcatacaggtttaaagaccaag

SEQ ID NO: 1748 - DNA, 121 bp, Gadus morhua
tagatgtgctacattaaatggcaactggcgctttatactataaataccacaagtttaggcmatgtatagttggggcatttaaaattaaaaatataaattgcccctccagtgtatcggcaca

SEQ ID NO: 1749 - DNA, 121 bp, Gadus morhua
atctccttctccgtgcggtggcgtacaaacagggggttttcctctccacttgaaggtcatrttcctgccctcgggaatatcagccaacttgacttcgattttggacaaagccaagacatca

SEQ ID NO: 1750 - DNA, 121 bp, Gadus morhua
aaaagagtgtgggaatcaatgagtcagccaattgtacaggagtattattagattgaattarcctggttgggccatgacaccggggtaacccctactctttgcgataaatgtcctggtatct

SEQ ID NO: 1751 - DNA, 121 bp, Gadus morhua
acatgtgaaatgacatttgtacacacgagatgtggttcaggatgaaaggtcatataaataragaaaatttaagaaaataccaacatggaccataagttgtagacagctaaaagcagtattt

SEQ ID NO: 1752 - DNA, 121 bp, Gadus morhua
atcaactgatggcagtaatgtcaatgacaagggttaacaaagaaagcttcgtagctgatgrtgattgttaggtgacatttttctattttcttacaacctgtgtaagcaatatacagacctt

SEQ ID NO: 1753 - DNA, 121 bp, Gadus morhua
ggacggtcattggtttgaatccctctgagaagatctgtaatgaatcagtcatttgtggtcrctactcctcatgtacttccagagctttgctgacggacggcgggatcagacccgcggccac

SEQ ID NO: 1754 - DNA, 121 bp, Gadus morhua
aaatggtaaaatgtcattgttattgttattggccactgcaatagagtaggggttatttgarattcaaatattttgtataaagttcggattagatattatttggttacatatttgtttcctc

SEQ ID NO: 1755 - DNA, 121 bp, Gadus morhua
tattttgcatgcaaaaaaagagatgtaaaaaacaatgagaaaatacaaatttgaaatatcmacaatgtcgctagaaaaataaatgtgtccttcaaagcaaacacggtaacaaatgcctaac

SEQ ID NO: 1756 - DNA, 121 bp, Gadus morhua
tataaatgtctcgatcagtattttctcatttttaacgaagaataaagtctcacattttatrtaaaaatgactacaggttgtatcaatagcagaactattctgcmgattatgtgtaaaatgt

SEQ ID NO: 1757 - DNA, 121 bp, Gadus morhua
gaggtttaagaatatatttcaaatgggcttggtctgacagttttacaaaaaaaaaaaatastgatacaaatcaatttcatgactactatttctaagtacattcaacatgtgatgagctgtt

SEQ ID NO: 1758 - DNA, 121 bp, Gadus morhua
acttccctcatgaaatgtcttattttccatacaacactcaatcaaatctttaaaaggacawtttcagttgactaatactatcaaaatgcagcattggtcttatctttttcatcctactcat

SEQ ID NO: 1759 - DNA, 121 bp, Gadus morhua
caagagaaaagagaaaacaatcaaatccagatttgacaaagatagcatcacaatatcaccrcaatggtttcatttcacagaaaaaaaaaagaaacttgctagttggagtacaaaacgacaa

SEQ ID NO: 1760 - DNA, 121 bp, Gadus morhua
cattaaatacacttatttttgggaatagcaaggcgttaactggtaaccgtcagaagccctytggggactcggtaacagatggatatccacacaaaaaacacaaatcaagccaaacccagaa

SEQ ID NO: 1761 - DNA, 121 bp, Gadus morhua
ccaaaagacatagaaatgatcaaatgttgatgtaattgttcaatcagtaaatacctgattyagtacattcttgaatgaaggacaccaacatgcttatttttcctttgtatggcttgatttc

SEQ ID NO: 1762 - DNA, 121 bp, Gadus morhua
gactgctatgttcaaggcagtatgtttgtatgttcatcgtttaatttgcactattgggctyttttttggtatcgtcctgttttgatcagtatatgccaatgttgttatcaataaaaaaaca

SEQ ID NO: 1763 - DNA, 121 bp, Gadus morhua
tgttgttatcaataaaaaaacatttgcacaaggcaagccgatgcacttctccatgttgatwagagcattaaaatgagaaaaatkaatgggacaaagaaatgaagggatatttagcattaaa

SEQ ID NO: 1764 - DNA, 121 bp, Gadus morhua
tctcaaataaagaaatgtacaattggtattccatgaagctgaaaccaccgtttcctgctcwtttaccccctgatcagaaataaaaaggtacaatggtacaattcttctgggttcagtaaca

SEQ ID NO: 1765 - DNA, 121 bp, Gadus morhua
tgccgtcgggcattcccgcgcagatcatgttgtccgtcagccgttggctctcacctgccarcgatcggatgcacgtctgctggttgacgacggggggactgaaaaacatcagcttgttgct

SEQ ID NO: 1766 - DNA, 121 bp, Gadus morhua
tactgaaggtacaccagtgttcaacaactatattataggttaaagcaatgccaacagtttyaaatacacatttttcattttctgtaaaatgaaagcaccgaaaggtatactgatggcatgt

SEQ ID NO: 1767 - DNA, 121 bp, Gadus morhua
tcagttgaccaagataaacacatggtgtaagcatctgtaaaaccataaaacattttaaatktggtcttttcatttcttttacttattggactttactataaagaatctcaagccatgttag

SEQ ID NO: 1768 - DNA, 121 bp, Gadus morhua
atttgaagggacaagttttatcatgttggagaacataatgggatcaagtgaggtaatagtktcagtaaagcaaaacaccagggaaatcctgctgatctctcactcattcatgttcatgaag

SEQ ID NO: 1769 - DNA, 121 bp, Gadus morhua
ataagcggacatagaccagaggcaatacgcttggcaaaaggaccaaaccaataccaaggcycaagtcattgcccttcgtgatctctcaacagacatgtccacgggaacaggttggcatggg

SEQ ID NO: 1770 - DNA, 121 bp, Gadus morhua
atcaaaccgtacaatatttaataatcgaaaaccaattcctcactcagaaattacaagtctyttactagaaccttatgaatataaaataattatagctggtatgcacaaatgggcctttttt

SEQ ID NO: 1771 - DNA, 121 bp, Gadus morhua
gtgatactagcttccggatgtctggattactatactacaacagggttttcaaaggatgccraagtgaactgatggcagcttttttccggttaaacctgtacatggttctacttttaggtat

SEQ ID NO: 1772 - DNA, 121 bp, Gadus morhua
gagacaacgccctcaactgatcccgtcagatccattacgccgttctctggaaaaacaaagsaatcagctgaaccggtaaattgaactcagatcactgtaggtcagatccatcctcatgaac

SEQ ID NO: 1773 - DNA, 121 bp, Gadus morhua
tatttacatccgttaatagtgatagaattaacttgatctctatatattcataggccttggmatatactttgttcccttcattgcttgggtttcagctgagttgcaacaactccaaatatta

SEQ ID NO: 1774 - DNA, 121 bp, Gadus morhua
gatgagtggatgaattacagggggtggtcctctgaccgaagcccaggggaaaggagaaggrggcatctactgaagacaacggccatactgagtaaatacgcaacacggctttccccaacat

SEQ ID NO: 1775 - DNA, 121 bp, Gadus morhua
aactcacaatctcttttgcaaaagcgatacttcaggcacagtcaagcactctttggttccsttcaggttccctctgaatgtcaccaaaagttattgaataaaatccacagaaaaactcatt

SEQ ID NO: 1776 - DNA, 121 bp, Gadus morhua
gtcccaccagaagatggagacagagaccatttagttgacaaagcaaaaaggaaaacatcamtgcagtcaaaagataaaataaagtaaccaacgtcctaaaatacattttgtttgacgttat

SEQ ID NO: 1777 - DNA, 121 bp, Gadus morhua
tcaaaatgtaccccaatacctactttattatatccattcagctctggtaaaatcagtttgratgttagatatgtgacatttaaacaattaaaaggatcttagtgttgatttggacgttcat

SEQ ID NO: 1778 - DNA, 121 bp, Gadus morhua
tgtatcattctctggtcctcatgtggcaataagcagccaaagaacagtattcaatcagctrcacaatgtgatccctttttattcaaccacaacaacgtgtctcgtgtgttgaagaaaagcg

SEQ ID NO: 1779 - DNA, 121 bp, Gadus morhua
gtcaatatgatagctgcttaaaaaaagatatatttaaatacacttattattcacaaaacsstggaagtaacatggatcatgatgttttgtcagaaattaacagggtgtttacatatggcca

SEQ ID NO: 1780 - DNA, 121 bp, Gadus morhua
tgtgcctctacagtacttgttcctctacgttatacctgaaattcactttctcctgagcaarcgggtgttctccctacgggtcaagagcagagtcacayctccccactgtacaagctctccc

SEQ ID NO: 1781 - DNA, 121 bp, Gadus morhua
agagcagagtcacayctccccactgtacaagctctcccccagcgcacggggagaggagagyagcctctgaatcgaaccgggagtcgggagaacagggacaaaaggtagatagagctggatt

SEQ ID NO: 1782 - DNA, 121 bp, Gadus morhua
acccaaaccatatatgttcggcaacatcgttcaccagtagttaagcactttaatggttgtwataaaaccccaatccactgtggatgaaaggcatattaaaattaaacaaaatcaaaggctt

SEQ ID NO: 1783 - DNA, 121 bp, Gadus morhua
ctgtgaggttatccctgcagtctccacatctgggatttgaaggctgagctaaggacctgamcaggtacctccaacatctccgccttgccatactgagtagtttccaggtgtacagtgtgga

SEQ ID NO: 1784 - DNA, 121 bp, Gadus morhua
gatattgtgaggaatgaggccttaacacctttaaaccattcacttaaacttaaaaataatrtattcccccacataaacactcactctcacattatgatacacaataaccaagttatagccc

SEQ ID NO: 1785 - DNA, 121 bp, Gadus morhua
ctgtagaagttgttcatagaaaaaatatataatttatcccagagtaaaccaaaaaatatgyattaatatattgcttactatgcttgtttagggaaggcaggaatgaagtacattttcccaa

SEQ ID NO: 1786 - DNA, 121 bp, Gadus morhua
agattaaacgacctgagggacggctgaataaccatttacaagtatatcatttaacaaatcmtctgatccttcctccgttgtgttacaagactatattttgagtgatatgggcattagaatt

SEQ ID NO: 1787 - DNA, 121 bp, Gadus morhua
tggatgtatggatgatatttaaaatgtttgattaacatgttattaaacttttttttctgtwattggtataaaatgtttttcattataattaaagcttaaatacactttaatcaattgcact

SEQ ID NO: 1788 - DNA, 121 bp, Gadus morhua
ttaagacggacagcaataggagccttttccctaaaactgttcacagaggtacttgtacagsaaaaattaaatcgtgtctagttgggaaatgttgtgaaagcccctcttatttcgaccacta

SEQ ID NO: 1789 - DNA, 121 bp, Gadus morhua
taacgggcctcggccactcccttaactacactctatgttagacccggacgcctggaagcayggctttaaactaccgacaacgtttgcacaacaccacaggaagaacgggggacatccacgt

SEQ ID NO: 1790 - DNA, 121 bp, Gadus morhua
gcttggacaaggtaggtcgatgcaagcggttcgctcacctcctgtggcctctgagcactgrgctgctcaaaaggaaccatcattggctggagaactggttgtgcagcatctttacatgaag

SEQ ID NO: 1791 - DNA, 121 bp, Gadus morhua
tttaaacaggaaaaagtagtatcaaataaagtgtttctatcacataagtagcaatcaaagraagtcccagagccaatttagttaattggtgcggtcaaaggtacaatagaactggcccaaa

SEQ ID NO: 1792 - DNA, 121 bp, Gadus morhua
ggttggagtatatttcagacaactctggggtatatttcagactctttcatcgaaagtgagyggagttgttcacatttcaataaggagcaagtaggggtcagagccgtcctgctttagggac

SEQ ID NO: 1793 - DNA, 121 bp, Gadus morhua
acttgtggaaattcttctttgcttcgttgacgaagaagtcggccatgaagaaggtggtttkgatggcgtatggtgagtgggggatgtagtcccgggtccactcgaaggcgttcttctcagg

SEQ ID NO: 1794 - DNA, 121 bp, Gadus morhua
cattggacggagaacaaaaatataagggaaacatattttgtttcactgtgcttcagacttwcagcagttcataacaattatcaggctagtaaaataaagaatcgtgactgaacaaggagca

SEQ ID NO: 1795 - DNA, 121 bp, Gadus morhua
ttattcaagaaacaataatattaatgataaaacagatttctatatttgtcaatccagtttkgaaaataagttaggaatgttttaaaaggcggtttgaaagacaaatacttgatgtttttcg

SEQ ID NO: 1796 - DNA, 121 bp, Gadus morhua
cgtgcgcatatacatgtattgatacagataacggaaagtgcagttctgaattgagctctaractgctgctacactttgactgtgggagaaaactgtgagtatgtgcaggtttgcatgatgg

SEQ ID NO: 1797 - DNA, 121 bp, Gadus morhua
gtgaggaagatggaggagttggcgtcactgggcgctcatcttggtctgggccccttgcagrgcggggaagaaggtggaatgcaatagggcgggtttaggatagccaatccggggggccacg

SEQ ID NO: 1798 - DNA, 121 bp, Gadus morhua
ggaggccatgatgacattagttcctgatagcaagtggaatcatttcgcccatttgagaaaraaaggcgagcgaagtccaagttgtgctgcaggtggtcgtatggtgcagactgtacagccg

SEQ ID NO: 1799 - DNA, 121 bp, Gadus morhua
acctgcattcatggaaagacgtcagcaccgtcccgacgccctggtgaaggcccgtggcagmcattttagaaacatctgccatggccacgggattgatacagcatgtgtcgttgtggttagc

SEQ ID NO: 1800 - DNA, 121 bp, Gadus morhua
atgtctataacaaaccccaaatgataccagtgcaaaaggagggtgtgaagaagatacaaamaaaaaaagtctgctgaattgctggttcaatctctcaacatgtcctagaacacaaattcat

SEQ ID NO: 1801 - DNA, 121 bp, Gadus morhua
acttccaccagcagataaagtatttgaaatgttagcattttcttttaaatacacaatgtaraattatcataacaatctaacaatcatattcattgtgctgacaaattattttttaaattat

SEQ ID NO: 1802 - DNA, 121 bp, Gadus morhua
tagatacattatgcataaaatcacttttccaaaaagatcagttagatcttgaccattaatwtccacttaatattcttgagatgctgcatgtccctttttaatagtattgtgattcataggc

SEQ ID NO: 1803 - DNA, 121 bp, Gadus morhua
ctccttgaccgcggggagcttcccttgcacaaggatttcctccaggaagaagcgaaccagyggggcttggtagtgcctgaagcccagggtccccaggcacttcaggatgcgagcgaggcgc

SEQ ID NO: 1804 - DNA, 121 bp, Gadus morhua
atgccagttcatatttccgaatctctcctgccagtttgacgctctcccgaccggtccggtstccaggttagagagctcaatgccgtagaagtccaacttgagcccgtaggactgctgcgga

SEQ ID NO: 1805 - DNA, 121 bp, Gadus morhua
ctttttcttcttctttttcttcttttctgtcgtttcctctgattttacaactacttcctcytcctccgcagcgggttcctctgccttcttatccttctttttcttctttttgggaggttct

SEQ ID NO: 1806 - DNA, 121 bp, Gadus morhua
cacttgcggatacctgtatgaatcagagtatgcacttgctttcccattgagtttttacatrtaaaaaaaatctttataaagttcttgtaactcatacaaagctttgtattaaatataaaca

SEQ ID NO: 1807 - DNA, 121 bp, Gadus morhua
tttctgattactacttccttacaggccacctattctttcatataactgccatataaccacrgcaaaaacaataagttacaatatgaatacattattatgcaaccccattggacggctgaat

SEQ ID NO: 1808 - DNA, 121 bp, Gadus morhua
actcagtgaggaatcaagacgacaatcaaacattgaaatgattatctacctttataaagtsgatcttgagaacactagatcaaactagaactgaacaaaacaagacctctaatcccgtaca

SEQ ID NO: 1809 - DNA, 121 bp, Gadus morhua
acagagcgttggcctcccggaggatctcatggttaaacggcacctcgcctgcatccaccgscttcacgtactccaggattatcctcactcggctgtggagcatctttatggcactgtgctg

SEQ ID NO: 1810 - DNA, 121 bp, Gadus morhua
atgatcagatacattttccttccatccttcctgcattttgatgctgacacatttcaaaacmtttgccggatatcatgtgctgctcctccactcggctagcgcagaagcctccaggacataa

SEQ ID NO: 1811 - DNA, 121 bp, Gadus morhua
agcggatctgcagtccggtgcaggtgtacttgggcagctcgaagctcagacccaccggtcycacctccatcatggaggctgagctcagacctgtgaacctccaacttaaagagtgcagaga

SEQ ID NO: 1812 - DNA, 121 bp, Gadus morhua
actggcatatacttctcgaattaccaatcgaaacatctcgcatattatctcgtcagtcgtrcccgcaaataaaacgttttttaaaagggggacgttcttaaaagccactgagcactggcaa

SEQ ID NO: 1813 - DNA, 121 bp, Gadus morhua
aatatttaactttttatccaaagatgattacaggctaaatatctaaaagttcctacatgtrttttggtcgtataccaataactccccatcaaccatatccattcagtggatatcataggaa

SEQ ID NO: 1814 - DNA, 121 bp, Gadus morhua
aataaatgggtgaaagtttacaacgtgataatacagtggtttctacatgattaagcttggwaattctactaacagttctgctaaattagccaaatagcataatagagttatgttaaagata

SEQ ID NO: 1815 - DNA, 121 bp, Gadus morhua
gtacttattctgaataaaaaagaaaaaagcccaaattgctctttacaagttaaacatgttyttccttgtcatttaatttaggtataaacagaaaaagtgaagtgctttcaggcacatcaaa

SEQ ID NO: 1816 - DNA, 121 bp, Gadus morhua
acctgccaattccagcggcaacataagacgggaaaacaaaactttagagtcaatgattgcmaagtgaaactctcaaagtcacaactatacctgtgtatgactatatttcatgtctagccaa

SEQ ID NO: 1817 - DNA, 121 bp, Gadus morhua
tgaaatgtagtgactcaataccatctcacaaggaaattctatggtaaagggagaagatttygtttttttcccattcctgggcctaacaagtcttgtgtatctaggctaaccaacacctact

SEQ ID NO: 1818 - DNA, 121 bp, Gadus morhua
tacaatttacagtcgatttgacatgtcttcaagacatccctgatggcgcccaaagaggatwaatgttcctttagagaaatgctgctggtattaaacttatgaaattatctttcaaaccctt

SEQ ID NO: 1819 - DNA, 121 bp, Gadus morhua
ctcaataacaaatggatatacacacacaaatagaaatatttattattctgggagagccgakagttgattgacacaaagtcaaagttctctsacatgacgwctttcacattgtctctaggac

SEQ ID NO: 1820 - DNA, 121 bp, Gadus morhua
ccatgttggccacacctaaccaacagagaatgctacatccaccatgcccagttcaatcagyccractcatccaccatgccaagttcaactcatcctccacggtcacgaagaaaaaaacacc

SEQ ID NO: 1821 - DNA, 121 bp, Gadus morhua
tggcctgtatttggtcagtacatgctggtgataaaatgtaccttattgataaatagaaatmgatagttaaacccaggaaaacagcattaagcaaaggccctccctaattaagcattgccaa

SEQ ID NO: 1822 - DNA, 121 bp, Gadus morhua
tagtgtagtagtaactgccaaaaatagacatccaaacaaaatgatttcaactctatgcctyaatataatacatgttattttgcacaaccgtttcaaataatgaaatataggtttgatgttg

SEQ ID NO: 1823 - DNA, 121 bp, Gadus morhua
aagggtttacaatacgtgtcaaagtataataaaacacattgattcaagtgtcataataacyattgaatattacatttatattagctatattgaagcatttcatactccctttctatcattg

SEQ ID NO: 1824 - DNA, 121 bp, Gadus morhua
agtcaattctttacagagatatctgatgagccgtaaatcagggataaggtctttgattagyaacaacaactataagtgggttaaaaggcttgaaaagatgtgaaataaacatgtccagtac

SEQ ID NO: 1825 - DNA, 121 bp, Gadus morhua
gggttactgtacataagaggcaaattaatgttaataaatttaattcaaatgtataaatgayttcaagtttaaaatgggacgcagcccagacacggagtggaccaaaataacacttggcaac

SEQ ID NO: 1826 - DNA, 121 bp, Gadus morhua
gaaagaaatgcaaaccaaacctttaaatattagtcaggagacactgctgtcttttgaacaraactaacgcatcttaatttctaatatgcatgacagcagaactaaatgctttcgccaaata

SEQ ID NO: 1827 - DNA, 121 bp, Gadus morhua
actaaatgctttcgccaaataatcttttccaagaattttacatttgtggaaataaatgttmtaccttatttaaatccataaaagatataatttctggtttacctgtgctctggtaaaatca

SEQ ID NO: 1828 - DNA, 121 bp, Gadus morhua
tccctactatattaccagtgaaattgtatacttctctaaatggtaccaaggcaataaaaaraacatacatttcatggctacaatcagtgataattacatgtgttaacaatgactattgtca

SEQ ID NO: 1829 - DNA, 121 bp, Gadus morhua
cccgtctgtatttcgtcgttcaggatggccttgctcaggaccttcaggggagacggtccgytgcacctcgaagccccctttcaggttgagcagggggaatcttctgggtgtctctggtgtg

SEQ ID NO: 1830 - DNA, 121 bp, Gadus morhua
acctttaagcctaacgcagtttttgctaccatccccaccctgcagctacacaaagtggcawagggcttccagccaacaacagtctcctcggcaaatcaacaataaacatgcttcctttcca

SEQ ID NO: 1831 - DNA, 121 bp, Gadus morhua
acacgccatcaacttttatgaataaactcaaaacattccctccaaaatcttcaccacatcsacaaattcacagtattacaaatagaaaacaatagatttctctgggtaaatatatttcaaa

SEQ ID NO: 1832 - DNA, 121 bp, Gadus morhua
ttagtacataatttgttagcttttctgcacacatttgattttttggacatttctaacaggycatatgaaatcaagataaatatttcaaacaattctgttgtacaaaagaaaggaaaccaga

SEQ ID NO: 1833 - DNA, 121 bp, Gadus morhua
tttcctcatttgatgagtttctctgtaagcttatgacatgtagacggagtatgcagctggytgactgctcctccattatatgaacacccccatacattcgtatccagatcactgtaaaatc

SEQ ID NO: 1834 - DNA, 121 bp, Gadus morhua
attcgtatccagatcactgtaaaatctcggtcgtcatgttgggggttacctaaaatttaaycgggcagcaaattagcattcacttcctaatgcattggggccatctgcagcgggtcaaact

SEQ ID NO: 1835 - DNA, 121 bp, Gadus morhua
atgacgatgaaataaaagacttagattaagtgcaaagacttctcaagaatcatattatcamtagattgattaaaaaaaagcgttattctccaacaatggtaataatggcaagtacaccatt

SEQ ID NO: 1836 - DNA, 121 bp, Gadus morhua
tgccctaaaatcaccccttttcccttcaccagcactttacttagactttctggtattgtgrcagtgttgggtgttaatcaaattgttcaccaacttgtactccaaaaccttggctacaggc

SEQ ID NO: 1837 - DNA, 121 bp, Gadus morhua
agaggagagctgaggtcactagcggcgtactaaaagcttcgataacaatgaggttcatctrtgcaggacaacagaggagtccatccacaaaccattccctacattagctcgaagtaggtga

SEQ ID NO: 1838 - DNA, 121 bp, Gadus morhua
aaaacatccgaaaaggaattctccgggtcggtattctcttgtatctacaacaataacaaamaaacccccaaaaaatacaacgcatggattggcatttggaacaacctagctatgtacactg

SEQ ID NO: 1839 - DNA, 121 bp, Gadus morhua
aatggtcactcctactagatgtatatattttttctacttttcatgtatattttattattckttgcttatattttggggtcccacagttaccacagcacacaaactaaatacctcttgctgt

SEQ ID NO: 1840 - DNA, 121 bp, Gadus morhua
tcaaaaaaataatcatttttactcaggtttcattctatagaaatacagatatcaccatgamatggttatattttctcatgattattaccttgttgatgtggttatgttgttacgctgtcga

SEQ ID NO: 1841 - DNA, 121 bp, Gadus morhua
cttgttgatgtggttatgttgttacgctgtcgaacatttaaacatgaatttcggggtgaamgatgtctgaatttgaaccgttgatcaaagagatggcacagttcaacatagaagctcttaa

SEQ ID NO: 1842 - DNA, 121 bp, Gadus morhua
agaaaaggtgattgccattcaaacagaataaccgacagatgttgaactaattgcaagttawacatgactcaggaatacacatttatgaacaatgaaatatcatctgaaacgaagttttaca

SEQ ID NO: 1843 - DNA, 121 bp, Gadus morhua
gtttaaactaacttatcgtgtgcagttgtatttccaatgcaatcatttatttatttgtaaragataactagatcaatcttcttaaagaaaaaagggtagattaacaaatgtaacctgacct

SEQ ID NO: 1844 - DNA, 121 bp, Gadus morhua
atttaaattcatcattggcaataacaagcaattggaactgcatttaagttgtcccctttgrgtgttcccaatagtttggaacagcaagaatcgtcctgaaggcatttacattaagatgcac

SEQ ID NO: 1845 - DNA, 121 bp, Gadus morhua
aaagtagagcccctatacgacatgaaatttactctcattttaaccctttttagtatgtaarcaagtatacatgtttttaccactctaaaaggttctgatttctttcgctctttaggtaatc

SEQ ID NO: 1846 - DNA, 121 bp, Gadus morhua
agggcagccggtcgtaggagccgtggggatagaggctgtagaggtggaccccgtccacatycacccctcccacaatcagggaggtgcccaggtgaccctggtacctgaagagcatctgtcg

SEQ ID NO: 1847 - DNA, 121 bp, Gadus morhua
ttaccacatttattgtgaaaatgtacacagagattaacggtaggacttctggtagcgggcrcgggctccagggccaccaaacttcttggactcgcagcgtctggggtcggcaaccagcagg

SEQ ID NO: 1848 - DNA, 121 bp, Gadus morhua
cagaggctccaggagcttgtactggagggtggcgggctcgatcatctccaggggtctgccrttcaccttgatcagaccattacccctcttacagtgagcaactgcggtggcagtttttttt

SEQ ID NO: 1849 - DNA, 121 bp, Gadus morhua
gcccatgacgggattggtttccgtggcgccgactcgtcatcagtggagtcatcgctttttkggtccatcccataatcctcagcactgttacttttaagaagtggtttgttgccacccttgg

SEQ ID NO: 1850 - DNA, 121 bp, Gadus morhua
ggttccctatcgcagcttgtgtcgaacgtacaaccccgtgcttcggtaggctacaaaacaraaagcctttcaggtgggtgatgtcacgggggtttcgttcatgtcgcggccgaacttcagc

SEQ ID NO: 1851 - DNA, 121 bp, Gadus morhua
tcgcattggcagcccaaacataaacgacaacaaacccagcagggtcgcgttgatttactgwcgttggcgtgtctagtgtgttaactcatctcatcatggcactttgacctcggataagaaa

SEQ ID NO: 1852 - DNA, 121 bp, Gadus morhua
aacattttgcaatagcgcagatgtcgtaactcactattatatagtgcattgtgcatcaccwagaggtgtccaatttttttccatttgatgggtcagtctgcctggatttcctagtgcatac

SEQ ID NO: 1853 - DNA, 121 bp, Gadus morhua
cgcaataaaaacttttcmaattcaattcaattttaattattctgcctatttgtactctgascatttgtatcattagaatgtaattctggctttaaaacaacataatagcagttgaagcgtt

SEQ ID NO: 1854 - DNA, 121 bp, Gadus morhua
gaagtaaaaaaacaaacgcaaccttttaacactgacatcgaaaaggaattatagaaaaatkaaatcagacatgtttgttcaaagttcataaataccccgcacgcacacacactccgaccct

SEQ ID NO: 1855 - DNA, 121 bp, Gadus morhua
catatttcattccatgatgacaaaataataaacttttattaaattgcatacagaaaaccargatatatcaagtaataatgacaataaaaataacttcaacatttagaaagaacacaaatct

SEQ ID NO: 1856 - DNA, 121 bp, Gadus morhua
ctggtcttcatctcacggctcagcggagtcacgttgaacaacaaatcacaacgtgaaaagycttctagacggcctgtttctccttgggaggaggttgaggttgaggagcaggaggagcggg

SEQ ID NO: 1857 - DNA, 121 bp, Gadus morhua
aggaggagcgggaggtggagcgggagatatgaggtcaaggtggtatggtatgggggtctarggggtccaaccctagaattatgcccacctgttcgctgtattttctacgatatttgacatt

SEQ ID NO: 1858 - DNA, 121 bp, Gadus morhua
acgtgggcttccctctagggttattactgcggaccctccgagcttctcagccagtgtgcgycgatccttgatctcctccagaaagtttgcctgcaactcatgcttgatacctgaaaacttc

SEQ ID NO: 1859 - DNA, 121 bp, Gadus morhua
aattaaaattattgagcaagataggccaaaacaatgttacagggggaaagaaagtatggawttcacaaaaattgacaagtttccataacctcccctcgggaatagataatacatgctgttt

SEQ ID NO: 1860 - DNA, 121 bp, Gadus morhua
gaatacacgcaacccctacaggaaaaggtattggtactctgtgtatcacttatttcagtargtccattgaacatagtcattccccacgttagacagcatcaactctccttataggctcacc

SEQ ID NO: 1861 - DNA, 121 bp, Gadus morhua
agcaaatcagaaatttcaaccggaacacatttgcatttcaaccattgtttatagttacagrtaccaccatccagaaacataaatacaagaaaaaaatatcttttgtttacaatctctataa

SEQ ID NO: 1862 - DNA, 121 bp, Gadus morhua
cttctaattcactaataatctacaattgaaaatcatatttccttcttacattgatttttcmaattttaaacgtgattcttaaagctcgaktctttcccacaaaagttccactaattaacac

SEQ ID NO: 1863 - DNA, 121 bp, Gadus morhua
ctcgyatactccaaagtaggtatgcagatctggggggttgaagtactgcttgacgatggcmtcatgcagattgagaccttctgcccatgacgggactgctttccgtggcgccatctcgtca

SEQ ID NO: 1864 - DNA, 121 bp, Gadus morhua
tctacagtgtagatcgccatatccaawttcaataaacgtcaccatcactggaacttattymaacgaagtagggggacaattgaaccgctgaaatcaattcccaagccgttaaccctcatag

SEQ ID NO: 1865 - DNA, 121 bp, Gadus morhua
gcgacagtgaactctagttttgattacacygccataaggtcagggaccacaaagccagaakaaatcatttggttgatgcctgtatatgttgggttggcttttgtcatttaatgagccatac

SEQ ID NO: 1866 - DNA, 121 bp, Gadus morhua
agaaatcaacaacatgaacaagggggaggcaaatgggaggaagatgaagacaaaagaggartggtggaatttaccgtctgcaaaagggtcgagtcgctccgggggagattgatcatctgtc

SEQ ID NO: 1867 - DNA, 121 bp, Gadus morhua
atcttgacttcctcctcagtgctgtctcccttcttgggggcagatgccttcctggggaacrggaccagtttggagcggtagatcttcaggcgctggacattggcctgcagagactccgtgg

SEQ ID NO: 1868 - DNA, 121 bp, Gadus morhua
ggttggccttctctgatgaatttggcatcaggtctcattggtgggaggagcctgcagaacmctcccatcccgttaaggtcagagtcctctgttgtgttgggtataggtgattggctgattg

SEQ ID NO: 1869 - DNA, 121 bp, Gadus morhua
gaaggttgccatctagtggccacggaaggaattaccaaccacaaacacaccagaggggcarttttgctcaagacgcacatgcaatagcctactacctccctcatgaatgacaaagcaccta

SEQ ID NO: 1870 - DNA, 121 bp, Gadus morhua
ctggaaacccactgaacaaatgctgtgtgtaactcctataagtcattaagcagaggtttgwaatccatagcaattcacaacgtatatacacaacgatacacgtcattaaggagcaggtcga

SEQ ID NO: 1871 - DNA, 121 bp, Gadus morhua
atttatgaaaataaaactaattttcccaattgggaaagatgttaagccaaaatcgtaattmgttttttcttatagtcttttcagagatagctaaatcaaattaattttgacctttttggca

SEQ ID NO: 1872 - DNA, 121 bp, Gadus morhua
caccaagaaaaaaaacaggacataataaatcaataaataacaagcagaccccccaaaaacmtacaaaattgtgtactactgtgatacttcaacactcaaatcattttttatataatgagtc

SEQ ID NO: 1873 - DNA, 121 bp, Gadus morhua
tacgttattgctgactgtattgtgaacattgtgctaaaggttaaatccttggataaccctrtttctagatgaagagagccttccctttatatctcagtgaacacagcacgtgaatacagag

SEQ ID NO: 1874 - DNA, 121 bp, Gadus morhua
ctaaactatcttaaatacacactccgagatttgatataaccagcagagaattattattttkttgtaagtaatttgtaataaataggattgtttttatttatatccataatgccaacacctc

SEQ ID NO: 1875 - DNA, 121 bp, Gadus morhua
tgtggtcgagacgagcccaggcttcaagcaaatggcagtggtgttgctcagcatgcacacrgccctctggaccttggccagatctcctcctggaaccacagttggtggttggtagttgatg

SEQ ID NO: 1876 - DNA, 121 bp, Gadus morhua
tgaatttgatatctcacacatgaagagaagtaaaaaaaaaatcgatgagccgcatcarttwgcgaaagggttggcatggatggtgacgtctttcattcgggtttcagtcagaggccggaac

SEQ ID NO: 1877 - DNA, 121 bp, Gadus morhua
gtcactggtatgtccggcacggatccagcggtcagcagtggtggggcacttctctacaatrtagttggtgatggggcttcctccatcattgtaaggcggctcccatgtcagagtgattgag

SEQ ID NO: 1878 - DNA, 121 bp, Gadus morhua
cagttcaattcgtggaaaagctcatgtctaaatatttataaaatcagcaagttaaacttgrtttaaaaaatgagcaattttacaactatgctcagtcatattatcatcttcaaaacagtgt

SEQ ID NO: 1879 - DNA, 121 bp, Gadus morhua
tttatgaatgccacgcggtacagccaaatataatatggacatagtggggacgatctgaaamaaccacaaccgcttggttattcattgtttcatattaatatgcaacagtaccttagatatc

SEQ ID NO: 1880 - DNA, 121 bp, Gadus morhua
actaagctatcattgacgtttcagtctctactgcaaacatgtggtacgactggattgaatwaaggtgtgttcgggataacaatatagagccatgggcagttgacccgcacccacttcagct

SEQ ID NO: 1881 - DNA, 121 bp, Gadus morhua
aagcagtagtaggcctataggatctggaattacaaactgcatcttgcacaccttatcttawaatgcatcacttcattttaaagtttgtgtattcactttggggtcgaggccttctgctggc

SEQ ID NO: 1882 - DNA, 121 bp, Gadus morhua
ttctatgggtctattctgcgtactggcggaaaatcggaagcgaaatgaaatggcctaattkggccgccttattatatgagagagatatgttcatggagttcacccataatgacttgtatat

SEQ ID NO: 1883 - DNA, 121 bp, Gadus morhua
aattgcaattcctcttggagtacctaacacttctaaagaagtgtataattaacttttaatwatgcttcatagagtttgctcttcaaactgggtacagaagtcgcaatagttaaggcagaat

SEQ ID NO: 1884 - DNA, 121 bp, Gadus morhua
tcatgatcaatgaatgtgattttatccctgttcagaagaactgaattgggaccacaaacayatwtttattgccctgttcacttatttgctaatttctttcaacattaggcttgctctcgca

SEQ ID NO: 1885 - DNA, 121 bp, Gadus morhua
acgtgttgaatgactcatttgttatctaaggttaaagctgaaagcagctattttggcccaycccactaagtggagcgggtttaagtttcttttaagatgtctcataatcttagataaccct

SEQ ID NO: 1886 - DNA, 121 bp, Gadus morhua
ttaggacagcatattggcaggagatctctactttaaatccgttttaaggagacttcctttwacaggaatctttatttaaaaaaagaaaaagaaacacacgttggcattctacatagcattt

SEQ ID NO: 1887 - DNA, 121 bp, Gadus morhua
agagcagatctctgcacagcagatgtttgcccattgttttttttcttcctttcctttgcaractctgccttttccttcaaagttgtaatgatgatctctctcttgtcttcgtgagccactt

SEQ ID NO: 1888 - DNA, 121 bp, Gadus morhua
cattataatttccaatgcaattcaactcacatttcaaatagggatatttaacaaattcctratattcagtcggccaatatgcctcatgtattactgtattactgtactcattgtgctcaac

SEQ ID NO: 1889 - DNA, 121 bp, Gadus morhua
gtgactcagccctaccggggcttggtggtatagaggctgggagtgcgccgtcctcattctstctggcagaaacgcttggagggggggtggttgaggcatactgtctctgaccgccctgcca

SEQ ID NO: 1890 - DNA, 121 bp, Gadus morhua
gtcaaaataacgttcttcgaaaagtgtaacattcatcattattttttcttggtttacttgraaacaatgatttatttgattgttattcattaaatatcatgtcaatgagctcatattggct

SEQ ID NO: 1891 - DNA, 121 bp, Gadus morhua
cggagatgaatcggcctcaaagtacccttgtagatattaaaagtaaagcgctatcagcaarctgtgacagcatgtattcaaaattcaacaatcactcttatttaacacacacaacttcagc

SEQ ID NO: 1892 - DNA, 121 bp, Gadus morhua
acttgtgcctgttaaagggaacacagtacaggccttcacacaacatttcaagctagtgttyttttttctatcaaagattagatttcgttggctgttgctaacataaatttgcctctaaggc

SEQ ID NO: 1893 - DNA, 121 bp, Gadus morhua
taacaacaatgtaggtttggtaatctggaaatccgagcagcgagtaaccacagtggaacamtcctctgttggagctcccatggtgccaaccacatgccaaccctgtgatactttcaactcc

SEQ ID NO: 1894 - DNA, 121 bp, Gadus morhua
gcaggtaggaattctttgttctcctagtccatgcacttcctgtatatgcccccccccctamccccaaatggcaacaactgatatctagacagagaccttctccctgtggggagcctcatta

SEQ ID NO: 1895 - DNA, 121 bp, Gadus morhua
ttaaagtaaaatgactctaattgtgcaaacatttaagcaaaattctgaaactaacaaaagrgaagaaattattaacaagcaggtcaaattgtaagggtttcactgaagtcatttaacaagc

SEQ ID NO: 1896 - DNA, 121 bp, Gadus morhua
tggaaataagacaaaatgtgacaggttcccctttagtatctacatctccattaaaatcacrttattcaaatgatctagaaaagctccacatttgagtaatgttagtgtttgaacaggacga

SEQ ID NO: 1897 - DNA, 121 bp, Gadus morhua
ttgatacgggactgtaatacctcgatagtgcattatcctcccagtacaactgaacagggaraggatctggccatgttttatgaaagcctgagaagagacaagagattttagatgtgtattt

SEQ ID NO: 1898 - DNA, 121 bp, Gadus morhua
atgagtctgttctgatactcggttctctggcgtgacctcgggagtctttctggagctctarcttcttgtactgatatgatactgctatgaggttctaagtcctcaccggagaaygaatagt

SEQ ID NO: 1899 - DNA, 121 bp, Gadus morhua
tatgttcaaacattagagaacaacgtccaacgaggatttctagataagaatttcagtaaarccctttggtaaaaactatttcgcaaactatgctgaaccccggctaacagtcataactatc

SEQ ID NO: 1900 - DNA, 121 bp, Gadus morhua
attaggacacaataaatagttgacattgaacaacggtaaaagccatgttgttaactataawtgcctataattgtcaaacccaataacctaacgatggccaatcaataaaacaattctaaag

SEQ ID NO: 1901 - DNA, 121 bp, Gadus morhua
tggagacccaccaatagcatgtgtccgtatacctgtggaaagcgctttaacgcgatactarctgcctgatagaaaatagatcttgtttttagaaacaggtcatagatgtcaatgctttttt

SEQ ID NO: 1902 - DNA, 121 bp, Gadus morhua
tgcctgatagaaaatagatcttgtttttagaaacaggtcatagatgtcaatgctttttttktgtatctaatacattctgtaatatgaaacaaaaattgaattggctgaaaacatggaccaa

SEQ ID NO: 1903 - DNA, 121 bp, Gadus morhua
gacagtttcaactttctgatgtggggggttccaagagtaatctctttattaaccttctgcrgcaaagcttttacagggagactctctgctggagattcatcaagcttctgagctactacaa

SEQ ID NO: 1904 - DNA, 121 bp, Gadus morhua
ggtgaagtactttgkcatggggcaggagactctgatctctggttgacttgtggttccaggsagaaccatttggcgggcgtgtattgtgaagggttagattacgggttttgctcttctccaa

SEQ ID NO: 1905 - DNA, 121 bp, Gadus morhua
aggtgccagtttagtccagctggaatatttatgatcgccaagaataggacaacccagggcrcaggccaaatgcactctaatctggtgcttcagtccggtcagtggctccagctcaacaaga

SEQ ID NO: 1906 - DNA, 121 bp, Gadus morhua
ctcagctgcccatgcgttccctcatgatgtttaagatggtattcgagcaaaaggcgtaaarcagaaatgtattgcggcagacttaagatggccacatcagactcgaaaccttgctgtttca

SEQ ID NO: 1907 - DNA, 121 bp, Gadus morhua
ttatttatgcgtgatgaaaacagaggctgaaagacagcgctctagatggggtgcctgaagytctggccagcgaacttggccttgtctccgagctcctcttcaatcctcagcagctggttgt

SEQ ID NO: 1908 - DNA, 121 bp, Gadus morhua
gaatcaacaatcccattggttggctgaamtagtgcacaaagactgaacacagagactcacrattggttaacactaacttcctccaaccaatacggaggaatactcttttaaaaagtagtca

SEQ ID NO: 1909 - DNA, 121 bp, Gadus morhua
ctcaatacaattaacataaacttaaaaaaaatctatttgtcatttttttttaataattttmtcttttcatacaaatcttcacttcaatagaaggtgttagcttgcagagatgaaacaagac

SEQ ID NO: 1910 - DNA, 121 bp, Gadus morhua
ttgattagaaaattcagaacacctgttgcatctctcctgccacaccaacaggagagccgtkcggtcaccagcttccgtactaaaccttgtattccgattttaataccaacacgtcgttcac

SEQ ID NO: 1911 - DNA, 121 bp, Gadus morhua
atagaaaagtcagtaaaatagttttctagaagtgtaaaatggaattttgcgctacaatgcwagcagtaaccaaccactcatgcatatttctctgcttttcatcatataaatccacacatca

SEQ ID NO: 1912 - DNA, 121 bp, Gadus morhua
aaaaccctcagtttttatttgtgccatgtgacactcatcactctaggaccaatcagcggtrgctcctccccactccggggcctgggcggtgggggctgcggaccagtcctcggtggcaggc

SEQ ID NO: 1913 - DNA, 121 bp, Gadus morhua
gtcgctggtgggaactgctggatagggcacagacgggacggcgacgccctctgaccaatckgccacctccgcctgagcgaactcggcggcgggggcggtccactcagcctggaactcctcc

SEQ ID NO: 1914 - DNA, 121 bp, Gadus morhua
cactaaaagttctttacaattacatttatgacggacatcctcgccgaaactgaatcgtttygcccatatcatgacggactgaagctttacgatatggtattgaaatacaaacaccataaaa

SEQ ID NO: 1915 - DNA, 121 bp, Gadus morhua
atgtatacaacatattcataaagtattctctactaacaacttgtgtcgaagcgcacaaaascccccccgaactcaagaaagtattaagcgacaaacttccagcatttattgggccgggacg

SEQ ID NO: 1916 - DNA, 121 bp, Gadus morhua
aacattgatcagtaaaaatggcaggtactgaaaacatgaagatcaaccaagaacagaggtygtctacaatatatagaactataaaaatctactcggcggacagaaacgctagagattttgc

SEQ ID NO: 1917 - DNA, 121 bp, Gadus morhua
aaattagtagtaagacattgtctgaagtgcaatggcatagctcagatgggttaaaaggtgraaaacaaaaacaaaaaaacgtctcaaaataaaaatatttttctatttttccaacaaacat

SEQ ID NO: 1918 - DNA, 121 bp, Gadus morhua
tttccaacaaacattaaattctttacagagtagagactgtattatctgctgtatttaaacytgtaaaaacatatttacaaatatccatcatcttttatatactttttctgataatcacata

SEQ ID NO: 1919 - DNA, 121 bp, Gadus morhua
taggcctctggagctattgaagaccgctctggtgttcccatcaccagcaggggctcacatwggatgaagcttcaccatggggacccggcagggagggaaggacctggttctcggaacacaa

SEQ ID NO: 1920 - DNA, 121 bp, Gadus morhua
gtttatgtaaatgtccgccatagcgcaatttcgtaagggacagcttttaattttcttctgygacaccacacaggtcttagaataaacctggcttcgcttatcgtttgatattagccaaaga

SEQ ID NO: 1921 - DNA, 121 bp, Gadus morhua
aacctcaaagattgcatcataaatatagaccaattggttactcaaaaacaactccctttaracaacaatctaaaaaataccttgttctgttaaatatgttgcttcattttggaaaataaaa

SEQ ID NO: 1922 - DNA, 121 bp, Gadus morhua
atggaaaggaaacatttgaaatgtaaacttgtgattgaattgttatattgattaaaaccawtctcagttaaatgttgtcgtttaacatgaggactaaaatgtagaccatataaactttcgg

SEQ ID NO: 1923 - DNA, 121 bp, Gadus morhua
ttgtgatgcttaatcttgttaatgagggttgtaatacatattatcattcaaacgaaattckttttagtgagattttagtttgatacaatgtatttgcttttataagatacaatagcaccat

SEQ ID NO: 1924 - DNA, 121 bp, Gadus morhua
gtgcatggggttgccaggttaccgcaacatagcaacgtcagcatctcgggcaaaaccaagyccagtaccaaaccaccaccgaggaagagctttgacattgattgtggatggttttgttggt

SEQ ID NO: 1925 - DNA, 121 bp, Gadus morhua
aggaagagctttgacattgattgtggatggttttgttggtgccttcatcaagtctttaggrgatgggtgtgataatgacgctttcataaacacactcacattatgacgaccaacttcacag

SEQ ID NO: 1926 - DNA, 121 bp, Gadus morhua
tttagttcaaaggaactcccatctagttgcacaaataataacgtgtcaaactaatgctaaygtaaaaaaacatatggtgtacatcgttcaacagacacaaaccactgtggctggtgggtgg

SEQ ID NO: 1927 - DNA, 121 bp, Gadus morhua
aaatgagaatcattgccatcatctcacatatgggttaggccctacagtatctagttagtaraagaggtggaattgttaagtaaagacttacaaataaagaagttgtccagttgaatattaa

SEQ ID NO: 1928 - DNA, 121 bp, Gadus morhua
tcttgggttgctaaatcctaactaaatacgctggttaggatacataagataaaagggtacyatatagttttatctctacagaaagagtgaggaggaaaacagtgttcatgttttcaaataa

SEQ ID NO: 1929 - DNA, 121 bp, Gadus morhua
twgagtttatacacaactttttaaaacagtatgcaaagagacttatttttggaagatattsgtccaagtaagtaacagggacataaaacatattaaaacatttattcacattcagttcata

SEQ ID NO: 1930 - DNA, 121 bp, Gadus morhua
tttttttacatcaatccaagagtgcgcctcagaacacaataagtccattcagtaatgccartggtcccgcaggtcgttcacatcctttacagtggcaggaattttttagtttctgtccatg

SEQ ID NO: 1931 - DNA, 121 bp, Gadus morhua
gcatttgaacttgttataattcagaatcacagagcgcagcttcttcaaggacccaaggtcmgagggcaggtcgctcagctggttgttcctgaggtccaggtgtgtgagctgcatcagggtg

SEQ ID NO: 1932 - DNA, 121 bp, Gadus morhua
aatgcaattaccaagatatggacagaatatataatttatatacattttcctgaagcaattrcaaagatgaaataataaataataatcagcatcacatgtttctgttttgcacaacattgtg

SEQ ID NO: 1933 - DNA, 121 bp, Gadus morhua
gccttatggtgaaaagaaaagtttgaatgtgcagtaattggttacaaaatacatttaaacmtgtcacaaaacaacacaaatttgataagctcccattaggtcatcactagctaataatatg

SEQ ID NO: 1934 - DNA, 121 bp, Gadus morhua
tctgagtagacccatgctattatttgtgctgtcttgaagatcatctggtcagtgttactgstctggacttcgtctccgattgacaagacagtgaatgccgaggttgtgtggatccttcact

SEQ ID NO: 1935 - DNA, 121 bp, Gadus morhua
taatattacttattttttagratgacattcacacatttaaaaaaaagtgggtttttaactraattgctagggcatcgagcctgcttacaaaagtatttgctttgagtgtgcggatcgagta

SEQ ID NO: 1936 - DNA, 121 bp, Gadus morhua
ccaatgatctgttttaggaaatcactcgggggtttgctttctcagactcatctcgacgacrctctggaagtggaagcgacaaacatttgggttgtgtgcgcctaccaagctagcatgaaat

SEQ ID NO: 1937 - DNA, 121 bp, Gadus morhua
acaaaacatatgcaaggggtcaccattatcgaagtttatatattactgttaagcaccagtktgatgtcatgctgccacttaaccttttctttgaaccaaggtcgatctttatataggatgc

SEQ ID NO: 1938 - DNA, 121 bp, Gadus morhua
gtaaacagatccttcagaaagatgcataaatttccataaaaacaattctttttttgtgtgraaaaaaaccccagatttacatatatccttttccgctagtgctgcatgtaaggctaggtca

SEQ ID NO: 1939 - DNA, 121 bp, Gadus morhua
atcccgctgtctagaagagcagagacaatagtattgcacgttcagacatccctccaatctktcataacgtgaagacggacatcccagtagtacaaaccaatcacatatcagtgattgtgtc

SEQ ID NO: 1940 - DNA, 121 bp, Gadus morhua
aataaagtaaaatcaccacatgacataaaaaaacagcatgattaaaaagcacacgtagctrgcaagaattacaatttattaatatcattgtggatttcagtctgggctagagggagcggta

SEQ ID NO: 1941 - DNA, 121 bp, Gadus morhua
tttgacttcatgtacatctttattttgacaaattaatacatatacatactctataaatatktccaaatactgtgtatccgttaaactggatgatgtggttttacatccaacagcttatcac

SEQ ID NO: 1942 - DNA, 121 bp, Gadus morhua
acacacacatctagaaatgacctggaagatgttaactgttcaagttgaatattccttatcmatgaataccttttaatttctatgttagtacatccatctcgtagctccaccattgaacccc

SEQ ID NO: 1943 - DNA, 121 bp, Gadus morhua
acaattttataatcaggccaaatgctaagctatcataaaaactaccatgaacactgaattygtagggattttctccagaattttctgaggacggcactcaccacaagattatcggacatgg

SEQ ID NO: 1944 - DNA, 121 bp, Gadus morhua
aagtttacagaaggcgtttytttcttccaagaatcactttagccagaatatttgttcttcrgaaagamaatcacattattactaaattatttctcgatataatatattgcatgctaaatta

SEQ ID NO: 1945 - DNA, 121 bp, Gadus morhua
gatgacactaatattcacagagaaacgtatttaaacaccttatatacaaatgacttaaaakcatgattaaaacacttaaaaagggagaaggataaaacaaaagtataaaacacactgtaca

SEQ ID NO: 1946 - DNA, 121 bp, Gadus morhua
gatgtatcaccatggtgacttatgctcgcaaccaaacctggtcgggagcagtttttcggcytagtctagccggagatcggttacttaaatcggcgtgcgcagcttcctagcccctcctctg

SEQ ID NO: 1947 - DNA, 121 bp, Gadus morhua
agaataggcagtcaaataaacaaagcaatggaatggagagaatattcctgaacattgcctrtaaaaaaaaaacaacggtaaatgcaaaatattcacctgcttcccaataaatattagatag

SEQ ID NO: 1948 - DNA, 121 bp, Gadus morhua
ccagtgaaccagtgttaaagggacagtcctgtatgagtgagcacaccgtggcatgtgatcygtcttgatgaaaggaatctcgcctggaaagcaattccttgtaaaaaaaacaatttgccat

SEQ ID NO: 1949 - DNA, 121 bp, Gadus morhua
cgaactgcacgccgagggtgaagtcgatgtctttggtgcggaaggtgctggattccttgaygtggaacttgtcgcccgactgctcgatgatcaccttgaggttgtcgtgctcggccagctt

SEQ ID NO: 1950 - DNA, 121 bp, Gadus morhua
gacccagaaaccagttctgccgctggttctgcatgcgctccattaattattctgccaggtygaggtctcctctcgtcccatagagggttcaacctgattaagcactcgtctgagtgtcgta

SEQ ID NO: 1951 - DNA, 121 bp, Gadus morhua
taaccattcatttgaatgcctgcgtgtctgctggagtcctggttccatggtcataatgtgyggggaaatattaattatagtcctatgataactaacatcgactgaagacaattagttgggt

SEQ ID NO: 1952 - DNA, 121 bp, Gadus morhua
taagaaagtaattgcattccctcatctgagaaaaaaaactgttggaccacttgcgtgttgmtccgaccagacagctcaggggccagaccgacacggctaaggacgtttcccgagtcttctg

SEQ ID NO: 1953 - DNA, 121 bp, Gadus morhua
attaaatataaaatagaggctgagtagggggactgaccccaaatctgatgaacaaggaatrgggaaaaacaaaaacgggtaaaatgttcagactaaaaacagaataaatgaacacaaccaa

SEQ ID NO: 1954 - DNA, 121 bp, Gadus morhua
atacactttacaaaatatcaagtacaataataacaatattaaaacaatattaaaacaccasaggaatatgataaaacagttaaaaattagtttaaaccaaagtattgagtaaaaaggtatg

SEQ ID NO: 1955 - DNA, 121 bp, Gadus morhua
gatacaatgtctcccattgtgagtgtcagcaggagggtgttgtcggtgacttccctgaccrgactggtctccttgcccgtcccacttctgggacgtgcaccaatttgcctccgtctaacgt

SEQ ID NO: 1956 - DNA, 121 bp, Gadus morhua
tatttcttactttctcactttctcaactcatttccaaacggcacctttaaccgtttaaccraaatccaacaacgttctgtgagtttggtttgcgcgtgcctgttggtgcctgtgtatgtgt

SEQ ID NO: 1957 - DNA, 121 bp, Gadus morhua
agagggcagctagctctttcctgtcaccatggcaatttctacaacatggggggaggggggwaacacccagggtgtagtgatcctttcaaagtaaatgtacctagagtgtaggaggtacatg

SEQ ID NO: 1958 - DNA, 121 bp, Gadus morhua
tttatatggtccaggatgagtgaataaaggaatcaataaatagggaaaccggtaatggttycactggctatatgtaataggattatgaattggataatatcccccaagtgctagattttkg

SEQ ID NO: 1959 - DNA, 121 bp, Gadus morhua
cacgcatctagctgtacaaacaagaaaatatttgcgacaaaaaattacccttgctggattwaccgttaaataccggctacaaagaggttgtgacattttcaaaaccacaacatgttaaaca

SEQ ID NO: 1960 - DNA, 121 bp, Gadus morhua
ggataggcatatttttgctaatacacaattattatctataatatcttaattagtgcktcaytatgactctctctggacgcccagtatgggattatgtgtggataataacaaccaagcttgt

SEQ ID NO: 1961 - DNA, 121 bp, Gadus morhua
ttcaacaattgaggatgttcaaaacttcaaaatgagtaccatttgtttggtttatcgtacragtatgaaaaatactttcagaatccaatgcttttgcccccactcttttgcaaacatcgaa

SEQ ID NO: 1962 - DNA, 121 bp, Gadus morhua
gctatgtacaaggggtgggagaacgcrgtctaaacagtgcagaaggcaccagaggtgctartttacttgcgtctaggtgttgcggaaaaccatggaatgcaacaaaataaaaagctttatt

SEQ ID NO: 1963 - DNA, 121 bp, Gadus morhua
aaacaaaattgataagaagcctgactcccatccttacaaaggacattcgaccaggaaggamatcacaagttaaaaatacataactrctggttgggattaacatggtcattgttcacccttt

SEQ ID NO: 1964 - DNA, 121 bp, Gadus morhua
aggagaccggagaactgcctttgtgacaaaggccagcttgtcgatacgcattcagaggacraacttccttctgcaggcatccacctcatgacgcttgagaacccactcgtactccccggaa

SEQ ID NO: 1965 - DNA, 121 bp, Gadus morhua
tcaatacataatacagtttaaagttggctaactgactctaatcaatgtttgtacagacagycaatctcacagtagtctgttacatgatagtaatatctaattccaattatatattttaatg

SEQ ID NO: 1966 - DNA, 121 bp, Gadus morhua
tagagatgtttatgtttgggtgcccagtgaggggttcttcctctgaggcttcctccactarggtgcctaaggtgaagagccctccccagatctatcgcaggagaactagctcgtggagctg

SEQ ID NO: 1967 - DNA, 121 bp, Gadus morhua
atgagccggaaacttggcatccctgtcctttctgttcctctcaagatgcttcctgactgcyacagccttcttgatgaggtggtagaggtcctctgggaggtccggggccaggcccttggac

SEQ ID NO: 1968 - DNA, 121 bp, Gadus morhua
attgaatacaaaaaatagtttttctcgaggccacttaaatacatttcacattggttcttcmccttactgtataccttcatgttccgaaatgatttttacggaaaagcacttcaatttcact

SEQ ID NO: 1969 - DNA, 121 bp, Gadus morhua
cttaaaagaactaactaaaagaaaagaataattaaaccagatatatttcacaaatttcagwtttaagatgaactttccatttattttcgtagctgggttatggtgtatggaccccccagaa

SEQ ID NO: 1970 - DNA, 121 bp, Gadus morhua
gtaaatatttagaaggtagaaaatagattaaggcaaatcataggagaatatcggtgatggyatcagtcttccggcatgaatataattttggccacatggtggcaacagattgcaggaccaa

SEQ ID NO: 1971 - DNA, 121 bp, Gadus morhua
taattttggccacatggtggcaacagattgcaggaccaactatttcttctcgtcatcgaasacatcggctacagtcttgtagattgacccagtaaattcatctagaaaaccacctggtgtg

SEQ ID NO: 1972 - DNA, 121 bp, Gadus morhua
tattttcactttttacgttaaacatatttatccgagacacagcaggaacagaatcacaatwatattcattatcataggatttttaaaaataaataaatgaatgtgctctctgttctgtccc

SEQ ID NO: 1973 - DNA, 121 bp, Gadus morhua
ttgccagcagggggaacatagagagacataaaaggtagcaatcaatctacaaaagagaaarcggcagataaaacctgttcccggttcaggactaggtatttccgacagtctttcaacaacc

SEQ ID NO: 1974 - DNA, 121 bp, Gadus morhua
tgttagctgaaatagataacaatatgtacaggaaacaaatctgtagaaattaaatgatctrtgttgttacttattgaccgtatgaatggtgtagcggtgtatcaaatattaaactcttaat

SEQ ID NO: 1975 - DNA, 121 bp, Gadus morhua
atgcaatcataatataattcctttttttacatgtaattataaataattagactcccaatarttagaatcatttgatattaattgaacacaaaaactggtaaaccagcaatatagatcacat

SEQ ID NO: 1976 - DNA, 121 bp, Gadus morhua
tttagactgagcccttaatatctgagggaggttcctacttccacagagccctgcgatgttscactgacatatttcctcagtaccctgaatatactaacagctctagagtacacacatgttc

SEQ ID NO: 1977 - DNA, 121 bp, Gadus morhua
tgcacataatattgaattggcagcagattattaatcagttaacaggtccttttagtcttcrstgaatttagaacaaaaaatagattgcggatcaattttagaaaataaattgttaaaggac

SEQ ID NO: 1978 - DNA, 121 bp, Gadus morhua
tagcagattttttttaaataaagacctccaccatattactatcaaaagtacttaaatgatmatttcaagataatacatttgcataattaagtgtccctctcaaacatctctggacaaaata

SEQ ID NO: 1979 - DNA, 121 bp, Gadus morhua
taaatacattgatctgcatgaaaaaccctcttgtgggttgtaattatattctctactaagwgctactgaaggaaattgttggttctcaaacagaggagtttggtaaacacccttctatgat

SEQ ID NO: 1980 - DNA, 121 bp, Gadus morhua
tcgacatacaacaagcagtcaagatttctgaaaatagatgtatawatacatccctataatwatggtgactttagtatttgaagaccaaaaggaggttcattgcaatgaaatatatggtatc

SEQ ID NO: 1981 - DNA, 121 bp, Gadus morhua
gtcatattagtctagtcctattcctgaacaaatgtaatctaaaaataagataaacaaaaargttaaatgacagtaaatggccgtgttatgaaatcaatgttatttactgtgtgttaccagt

SEQ ID NO: 1982 - DNA, 121 bp, Gadus morhua
tgttctgcaagtctcgcatgcgcctctacttgcactccatcctcccaaatgcctgctcaamgatgactctaccccggacgatgtcggtgttgctgcgtagctctgcatctgagagagcccc

SEQ ID NO: 1983 - DNA, 121 bp, Gadus morhua
accaatatgctttattataatggtttaaaagaaatacatgaataaaataaataatacaaamgcaaagtcctttgcttaagtaatcattttataggatgaagccatccaactaatgaaataa

SEQ ID NO: 1984 - DNA, 121 bp, Gadus morhua
ctatcgttgtttatcccaagctagcctctggtgctacatacaatatatactttatttttcrtggcaaagctcatccaattttaacaaaaaggtaacatggttgaacttaaaattaatataa

SEQ ID NO: 1985 - DNA, 121 bp, Gadus morhua
tagactgcctttgatagtgtattgttgttagatgttgacataattggttactagtggtttwgttttcacatgcaaaaatcacatatgtgacatgtaaacaatgttgaacatgcatggctta

SEQ ID NO: 1986 - DNA, 121 bp, Gadus morhua
aagtccaaaggccggacacagagggcccctgaagcggcccctgatgctgtggatgatcttrtgtctctcagtgtccaccaacgccaggaggccagcctcgtagtccagcagcacaccgacg

SEQ ID NO: 1987 - DNA, 121 bp, Gadus morhua
aaaaaagaacttgattttggtcattgtttttttcttgcttttaatcaggcaaatccttcaracggctacaatgctcactgtgtagcatggtcatggtcaaggctcagagtgcagtctccgg

SEQ ID NO: 1988 - DNA, 121 bp, Gadus morhua
tgaacaccaaccccattcgactcaaacagcaaaacactgtgcaaacaaatctgtatctgtratgaaaataaacaagagcatcctccttccaccttgtggattcagaagcagacggtaacaa

SEQ ID NO: 1989 - DNA, 121 bp, Gadus morhua
ataagtacagcacatgctgttttgcagccccaattcctttacattcatattatatttatakatattatccagtgctcagaaggaatcctcgctatttgagtcactggtgtacccctcactc

SEQ ID NO: 1990 - DNA, 121 bp, Gadus morhua
tccccagttacaacctgatataaatttaaacctgtccgttcattcataaaatatagcacakagtaacccaatgtattcatagctttaaaagttgtatccatatcacgttcactttaaagta

SEQ ID NO: 1991 - DNA, 121 bp, Gadus morhua
aatgccacttcatccaacatgagcgggtatatcttgcaatgttaaaagatcgaatagcaawgctggacactcatagtggtaatatctggtttaattctataaacattaaactatttgaatc

SEQ ID NO: 1992 - DNA, 121 bp, Gadus morhua
tttgttatatttacttatttgtgcttattatttattcatatatttatctgatatttgtgcwtttctgctcgctccacccttggttcagaaagaaataaggagtgcctgtgatgcattatgg

SEQ ID NO: 1993 - DNA, 121 bp, Gadus morhua
gcaggagtcattgcgaggtaaaggatagattccatgacatgaaaactggagcccgttccargtattatcagatgcgctctcgtattatcggtgcaacataatcttttcacatccctctcgt

SEQ ID NO: 1994 - DNA, 121 bp, Gadus morhua
tttatacaacaattcaataattggaatgttaactttttaatgaacaccaccatcctcatamcagtgatgaaaaacaaagtcacaataataacaagaagaaagctaacaataagaagatact

SEQ ID NO: 1995 - DNA, 121 bp, Gadus morhua
tgcagggaactgaattcctagccctgtatacttcaggtaaagctctgacacattccctttyttgtctgttggcagtataacagccaagggcaagtggtttgcacgtcgactttgatggaaa

SEQ ID NO: 1996 - DNA, 121 bp, Gadus morhua
ggctcatgcaatgccaaggtgcccagcgggccagtaaagttagctgctctcaggtaggctwtacctcattgtttttcttatcggacatgccaaaaacggtaatcaatccagaatggtgata

SEQ ID NO: 1997 - DNA, 121 bp, Gadus morhua
ttcagaggagccaagcttccccccaccgtcccgcaaagaaaaaggaactaaccctcraccrctccatggttgcaaagctttcagaactctaactctgaacataaaatgacatgactccggt

SEQ ID NO: 1998 - DNA, 121 bp, Gadus morhua
ccaatgaacttatatattttatacactcgtggagcaatgtttgcgctgttgtccaacaacyaatacacagaatacacatacataaaccattaaaaaacaaaggaaatttgtcacgaaagga

SEQ ID NO: 1999 - DNA, 121 bp, Gadus morhua
tacagatacaaacatacagaaaacgtacaaacgtgacatatttataatagtgtcttgcatmaaaataacaagcaaaacatgagtcaatcaagcaagcaatcattaaataacaactctaatt

SEQ ID NO: 2000 - DNA, 121 bp, Gadus morhua
cagcgacatgaatgcaggaagtgaaggacaaacgagcaaagtgcaggcctacgctaacmayaacaggaacgtataaagctcccttacgtataaaatacacgtacaacacacgggggatgtg

SEQ ID NO: 2001 - DNA, 121 bp, Gadus morhua
attgataacatcaaaatacctaataatcaccattgactacagatttttccaaattattttmagataagagctggttgatatgttacacattgttcaaatggagatcacaatgtttaacaga

SEQ ID NO: 2002 - DNA, 121 bp, Gadus morhua
catgatgtattcaaaggcactgtccatcagaccccccatgcaccccaagttgccataatcyccagagcagtccaccagctgctgctcgctcagggacaccagtttgcccgtcttcctagaa

SEQ ID NO: 2003 - DNA, 121 bp, Gadus morhua
cattgacttggcattcatccatggacatttggattagaaaacatgtcaacaaaatctgtcwttacaactagcatctccccatacatctacccatttcctccaagacctacagaccatgtga

SEQ ID NO: 2004 - DNA, 121 bp, Gadus morhua
aaatgccacctaaataccttaatcattatataggcatgtattccaggatgctgtctcatgrgacgacaccaattatttcccgtagtgttacatagtatgtacaatggagggctgttcattt

SEQ ID NO: 2005 - DNA, 121 bp, Gadus morhua
attatttcccgtagtgttacatagtatgtacaatggagggctgttcatttggttattttgrtgttttcaatgtgcagctacgacagcgcggtagttattgtgccaccttaacgatgtaaaa

SEQ ID NO: 2006 - DNA, 121 bp, Gadus morhua
gttggagaaaattaaacatatatatatcatattattggaatgtataacttacgtggtgaawgttgttattacgttatggtttggcagtttggcactgataagtgattgggttctatagcta

SEQ ID NO: 2007 - DNA, 121 bp, Gadus morhua
gagaccttcaaaaattactcacaaccttcctagatcataagcgtcgtttcggtgtcacatwacgttgcttgctgactgcaacaaaaactcagagcaacctggctcactttctggcacacac

SEQ ID NO: 2008 - DNA, 121 bp, Gadus morhua
ttgtttgactatgagtatttaataggccctaccatagttggaaccaaaggcccactctagrtgacagtaggccaataggcctccaggatacaatgttgatttcagtcagtgcctctttcat

SEQ ID NO: 2009 - DNA, 121 bp, Gadus morhua
ctgtgggtgaatactaaatttttagaatgttaatattccatgtttgaaaatcaagcacackcagctcaaaacatatatactatttagatgggcagtgcatgaaactgcaagattccacatt

SEQ ID NO: 2010 - DNA, 121 bp, Gadus morhua
acaaaccatggctataaataaattttaatgtgacaaacgaatatcaatactactagactgygtccataaatatacagaatttcttcaagaaaacaatattggtcgaaaccaaagagggcct

SEQ ID NO: 2011 - DNA, 121 bp, Gadus morhua
tgcaccaccaggtcatacggataaacaataggttcaatagggtaggaacttaagaaacaakcaataattccaatagggacaaagtaataaagtaagacaaaggtattcatggttttaaaca

SEQ ID NO: 2012 - DNA, 121 bp, Gadus morhua
tcactgttttggtatagcgtacttcagcgaatggagtaaagaaacccacagattaaaagarggtctagctaacaatccgataaaaatacaaataacatagaaaataatcagagtaaagtcc

SEQ ID NO: 2013 - DNA, 121 bp, Gadus morhua
aagctaccgtatacatacatcaccagcatgcacaatactatattatggagaataattggascagctatcgttcactgactcaacagtataataggcaagtgcatttcttcaccaataacat

SEQ ID NO: 2014 - DNA, 121 bp, Gadus morhua
aataactaaggaatcttaaaatacattgggggagaactattggcctggctaaagagaatamcccctcgaaataaaggagtgatgcaattctattcaccaattctgcgtagaatctgtgcag

SEQ ID NO: 2015 - DNA, 121 bp, Gadus morhua
atgacctaatttgggaccacggacttggaacgtaaacaattgacattttggggattatttkgggattccctcgtagtgacggattagcaaattattgggcagtcatggagcgtagtgggtc

SEQ ID NO: 2016 - DNA, 121 bp, Gadus morhua
cttatggagagttttagaggccagttctattgatctcaatgcagatgggaggcctcaggaractttgtgaacatgctgggtctgaatcgatgggaggccagtggtctgggtgtccgtgatg

SEQ ID NO: 2017 - DNA, 121 bp, Gadus morhua
ttttcaggctttaactaaagtcatcagttgattaaaaataagttaataaagttgataatcrggttaaattgtcccatctgaatcagtggtgtgtacatgatgcaaaaaaaacactgacaaa

SEQ ID NO: 2018 - DNA, 121 bp, Gadus morhua
atgttacactatatttattcaaaacatatatttttgtttgaccttttattgtcaagatgamtttcattgttgtatttttattcagcatttgaacccatgttaactatgcatgattgtcagc

SEQ ID NO: 2019 - DNA, 121 bp, Gadus morhua
tataaaaacaaaccctgattaaaccattatttaaataccaatgataaaagcacaacagackgctccaaagaccgccggctgacccgatgaaacgtaagtgaaacatggcaactagatcata

SEQ ID NO: 2020 - DNA, 121 bp, Gadus morhua
ttgtcagggtggaacttcaccgccagcttgtggaaagctttctggatttgtcggtcggtarcggtccgttgaatctccagagtatcatagtgggtcttctgggtcttcagagagctagtct

SEQ ID NO: 2021 - DNA, 121 bp, Gadus morhua
attagatatggttgttgaagaggatggttttggagttggcagacagcagtgccgttactgytctggaaacacaagatagtaaatacgctcctgaatcatgtacatatacatgaacgcagac

SEQ ID NO: 2022 - DNA, 121 bp, Gadus morhua
acagggtacattagttcgaaatacatacaagaaagaatcccaaaataaagtcaaacattgrcagatgtaaaataaaaaataaataattaacaggaaatctttgaactactgcgtttaacca

SEQ ID NO: 2023 - DNA, 121 bp, Gadus morhua
atgaaaacaaatattcatatttaaatgttccacattstaggactcctgtattttgaaacakatgtaggcctatttggacagatagattgacatagattgacttaaatagtaggtataattt

SEQ ID NO: 2024 - DNA, 121 bp, Gadus morhua
aaatttgacgttttcatacagcaggcattagattagaccactgaattgggtggcaaatagmaacaatattaaacatatgataacataagtaatggcatcttaaaaaaaccgtaattaagca

SEQ ID NO: 2025 - DNA, 121 bp, Gadus morhua
acggtattgcatttcatgtttacattcagttctttagataaactttatgtatatgagcttyttcatgttactgaagacctggatgcaatcatgttcatgcttaccacatcagacgctaara

SEQ ID NO: 2026 - DNA, 121 bp, Gadus morhua
tagatcttacaacttgctctgtgtcgaggtgcagacagatgcatctataaaatccatctgsttccatcaaaccgtatgccgaaaataaccatgcgtttgtaatcgtattatctataaatac

SEQ ID NO: 2027 - DNA, 121 bp, Gadus morhua
tgcatttaagtgggttattgtgaatgacatgggttattgtgaatgacataacaatttatcycagggctccagactgcaaccaaatggtcctcttttgcgaccaaaatttgagtgygactga

SEQ ID NO: 2028 - DNA, 121 bp, Gadus morhua
gttgcaacgaagcagcagccagtagagggcggtattgctttaaagaaataagccccccccmccaagacacacagagacacaatcaccctatacagctctttaaacaaacaggaatttctgt

SEQ ID NO: 2029 - DNA, 121 bp, Gadus morhua
tccatttttcagaaataacacttaacagtagtccacgtttttctaaccaaccattatgacmaaatatgttttaagagatcggtagcttttatctgctctttttctgcgggggaaatctggc

SEQ ID NO: 2030 - DNA, 121 bp, Gadus morhua
ctcacttttataatgaagtgtccataaaggtttctcaattaacatggacttaaattaatcrattaaggcaaaactatgttttaactdttgcttcagcaaaagatattcacagtagaagcac

SEQ ID NO: 2031 - DNA, 121 bp, Gadus morhua
cgtactgtattactgcccgatgaacgttactgtgaactcgttcattctggtgtctgtgaayggcatgctcactcggttaaactttgttcaattggggggttatttgtttatcaaagcggcg

SEQ ID NO: 2032 - DNA, 121 bp, Gadus morhua
tcatcatcattcacatcagagtggaaaaaaaaatgttaataaattaatcaaacatcaatgytactccctataacccctacaaaaacacctgtactttaagatcatttctctcttcttcctg

SEQ ID NO: 2033 - DNA, 121 bp, Gadus morhua
tacagtgctcgataaagctgttccaaaccgggtctgtaccgagcactatggggtttcccascatgatcagctgggctttggcacgagtcactgcaacattaaacctcttctcgttcttgac

SEQ ID NO: 2034 - DNA, 121 bp, Gadus morhua
ggggaacatttcaacacaacatgtgcggaatcatctgaaaacatctggaatcaagcttcwraacgtctaaacattagttaacaaaaccttttctacattgtgtcgtcgacacgatatctta

SEQ ID NO: 2035 - DNA, 121 bp, Gadus morhua
agaattccaattatgcgtaaatataggatagttcagttgaaagtgtcagtggttttttctwcaattcatacaggtccattacgtagattttaataaactttgtccaaccaattagatggct

SEQ ID NO: 2036 - DNA, 121 bp, Gadus morhua
acattgtgctttgagcgatgtacaatccagtaggccgtggtattccgatgaaacactgccrtttttaacaacattttgaaaatgctacattgcatccacaaagacactggaacaacaagcc

SEQ ID NO: 2037 - DNA, 121 bp, Gadus morhua
caaagctggtacatcatttaaatggatgttgctgcaaagcatgacattctccgcatcatgrctgcattattcagttggttgcagctcatctacaggcaggtttatgattatgcagtgacct

SEQ ID NO: 2038 - DNA, 121 bp, Gadus morhua
aaaaccactgggcttctcccataccagcatgattgtttttttcttccttcggtatttagtyttaaaatgtcagtgactttcggtaaaatgacayggaaccctgtttcgaaagatggattct

SEQ ID NO: 2039 - DNA, 121 bp, Gadus morhua
acgaaacacattacatttaatgattattgtattcaaactttacagaatctcactttcccawaccttgattcagaatcttacattmtttgaaacttaaatacgactaaacaatgtaacataa

SEQ ID NO: 2040 - DNA, 121 bp, Gadus morhua
gcacattctgatagcaaacgttcccatagcaaaccatgtccatcagaactcatgaaccccrctgtgagtttccggtagctccttaacgtcacagttttgaatcaaagtgaagtaaaatcct

SEQ ID NO: 2041 - DNA, 121 bp, Gadus morhua
aaggctttattgtattatgggcaagtttgaaagcttgtacatgattggaaggggggggaargggagaaaagactatatacaatatgcaataatgcaataaaaaaaagcatatacaaaacat

SEQ ID NO: 2042 - DNA, 121 bp, Gadus morhua
aatccaatgcacgttgyagaaatgcacattgtcaacagtgcaaccctgcaatgcgccttcyattgaatccctgccactctaagttaatttcatggtcagcggtgtcgttcacccgctgatt

SEQ ID NO: 2043 - DNA, 121 bp, Gadus morhua
tatacatgattactcttgtaggacaaggtagaagtacagctcagtttcaataatgaaacgktcagaactttaaaccattgaacattgaaaaccatggcgacatggggatcatacactgtca

SEQ ID NO: 2044 - DNA, 121 bp, Gadus morhua
gctacaaggaccacaatcaactcaaaacaatggcattgcagtgatactactatcgtagacraatgcatatgtatttttttcaaatgaatatcaatgtgtgcgtgcagttctctaatacaca

SEQ ID NO: 2045 - DNA, 121 bp, Gadus morhua
attaggaccacggaattgtagcacaagggtcattacagctccaagaaatgagacagttaakttatgtcgtctgaacacgagctccggcttcgagtcaacaaagcgaaagctgcatttgacc

SEQ ID NO: 2046 - DNA, 121 bp, Gadus morhua
tcctccgacctctttcaccttatcgttcacaaggttctgatgcttccgtacggcgttgaaragctgcactacacctctggtagctgttctctgaaaggtcctttcagcctcccgatctgtt

SEQ ID NO: 2047 - DNA, 121 bp, Gadus morhua
tgttttctagagagaacacacaaatgtttacagacacatcaaaccatttatatttcagaartaattgtttatgacagctcttgtcaccatggcacaaatataaaaatccaacatagcaata

SEQ ID NO: 2048 - DNA, 121 bp, Gadus morhua
ctggagcctcctccatgtgtttttttagttgttgtcactgctttttatagatctatatatwtttttttaaatctcatcgaattttgtcataaaagccgtcataaatatataaggcctgtta

SEQ ID NO: 2049 - DNA, 121 bp, Gadus morhua
ttttttacttccatctaaacaagtcattagtgagcaagctgccataagcaataagcgcaayagccttgtagtgaaatgcttgacccagaggtgaaactcagcagccacgtaagagcaaaag

SEQ ID NO: 2050 - DNA, 121 bp, Gadus morhua
acaggatggagcaggggtggagkggaggggaataccactagtgttatgaggaataagaatmatttctatgccaagaatgaaccacctcaagcgtcagaatggacaaccgaagaataagcag

SEQ ID NO: 2051 - DNA, 121 bp, Gadus morhua
gcgccaccgtagcacaacaactaaaaaggctattagtttggtcacatcgctcccgcaccgstcttctacggcaccccccgctggccagcggtgacccataccgggttcaccgcaagggtca

SEQ ID NO: 2052 - DNA, 121 bp, Gadus morhua
ccaatcacaggtttccttcaaagctttttcaaacggcgtaaaggcaaagtttgggaggtarcgcatcaactttgcattactggcggtctttttgaactgaccatctgatttatctgtgtca

SEQ ID NO: 2053 - DNA, 121 bp, Gadus morhua
agtcttccggtaattctttgtcactcattcctctaaacgtaaaagcacataacgatgaacrctgtttcaaactcatttaagatcttttgatgtatgtatgtgctttgaattgccagaatat

SEQ ID NO: 2054 - DNA, 121 bp, Gadus morhua
atgaatattcgccattgattaacttgggacggaaaatagagcctgcctcgttaagctctcrgggcacgaatcacaatcgatcaaaacagacttcagataacaaatggtaccaaagccaggg

SEQ ID NO: 2055 - DNA, 121 bp, Gadus morhua
ccagggaggaggggaccagaggagggtgtattgctccgtcagtacgggttcatgggggccraavaggaccagtaccagtacaggttggtttcacagaccaggcagcattgaaatagatcaa

SEQ ID NO: 2056 - DNA, 121 bp, Gadus morhua
aggcagcattgaaatagatcaaaacgttggaaagaaaaacagtaaaagcagcattggggaragggggggcgtctccgagtccaagacatcatgcaagcatccggtcaccagcaggcatttc

SEQ ID NO: 2057 - DNA, 121 bp, Gadus morhua
tttctttcagcctcattctgatatgcagtgtcaagcattgagtgtaggagaaagtgagctygtgacaatccagttcatagagcatctttgaaatataccgtcgccacacactcattaaata

SEQ ID NO: 2058 - DNA, 121 bp, Gadus morhua
agaaatataagaaaactttccaagggagatttctctttggagattggtttgggagaacccyttcaaactacactatttaaaactacgacgacaacactttgtgacctcacacagtgggcct

SEQ ID NO: 2059 - DNA, 121 bp, Gadus morhua
tcagatcgtttcttagtgtctatttggtggttgagatgtttttgtgtacagcgtctctttkgagtggtaaattaatttccaaaccaagaaacactacaaaaaggtcaaacaacaagaggac

SEQ ID NO: 2060 - DNA, 121 bp, Gadus morhua
actcaatgttttttccagttggaggctgaaatatgtagtgatttcagtttggatgtcttckagaatttatcaatcaataattagatatgtaggcatactttgcagattgttaccaaatact

SEQ ID NO: 2061 - DNA, 121 bp, Gadus morhua
atttcaggtatgcaggcagcagacacgacacgttttgtagaaccgggtggctgctgacgtrcattgtcaacgcagaagagtatttcacgaaggtgccccggttctcttggcagtgggcctt

SEQ ID NO: 2062 - DNA, 121 bp, Gadus morhua
ccccattgggtacagcacaaatctattatgggctcgcaaagcaacctctgtcacacgatkstctttttagacagacttctgtcgagcacatgaagaagatctcttcgtcgaggtacgtgtt

SEQ ID NO: 2063 - DNA, 121 bp, Gadus morhua
tgaagaagatctcttcgtcgaggtacgtgttggtttgcacattcatgaactggaacgcttwgaccaagaagcgcttctgcttactgctgccgtggccactcgtagacaagatggagatacc

SEQ ID NO: 2064 - DNA, 121 bp, Gadus morhua
ttgatgattctcgcattctcgagaaatgggggcctcacagccgagttctccattgttcttsaaggggagaacaaccgatgttctccaaaattgtattgtcgtttgtgtagatcagggaaca

SEQ ID NO: 2065 - DNA, 121 bp, Gadus morhua
ctcactcttgtgtccaccacacacacttctagctcctccctactaggagacgggaggccaygaaccaaacatgcacttccatgtacattccactgcttattacagccacattctgcacaac

SEQ ID NO: 2066 - DNA, 121 bp, Gadus morhua
aattctcaactttatttacatcaaatatgaattgtgggctattggattcatgcaaaaatgyatgcttgtactacacacactagtatacatatagatgtaaaactgcctaataatcttagtt

SEQ ID NO: 2067 - DNA, 121 bp, Gadus morhua
cgcggtgagatctgtagatatctggcgtgacaaataaaaccacttaaggtaacccttgaaraaagtaataaagtttttttctgttataaaataaaaccttgtattccgactgggaaacatg

SEQ ID NO: 2068 - DNA, 121 bp, Gadus morhua
atagagccaggatcacatgaacgtccgctacactgttttacaaatccaagaaacaccttcyctaaactctaccatacacaaggaggatgaagcagtagtgagcttgggtgtgttgctcatt

SEQ ID NO: 2069 - DNA, 121 bp, Gadus morhua
tcttcgagtcagcctctacagctgtagtaaagttttccataaaagagcgtgcgagcggttwtaggctgtgcaagtcaaacatggcagaactaatagagagagagttaacaacacattaaaa

SEQ ID NO: 2070 - DNA, 121 bp, Gadus morhua
cctccaaagatccacggcgaacgaatgagtggatccgcaacccatttgtcaatgtcccgawtcagttgtcagtgcaggaggaagatcaaatgatcgaaatagctaatgacggtggtcttaa

SEQ ID NO: 2071 - DNA, 121 bp, Gadus morhua
ttagacaagaaagagaaaccaatcttctctagtttcacttaccctctgatttgatcataayacaatttatacaaaccccatttcgaaatacaaaaataattttcttttaggtaacattttg

SEQ ID NO: 2072 - DNA, 121 bp, Gadus morhua
agaatcatgatacattacaaaatgtgcaaccactaaaatagcattaatttatctatcaacytttgatcacttatgcacagctcaagaatttcaagcaggattccaacacaatcaattctaa

SEQ ID NO: 2073 - DNA, 121 bp, Gadus morhua
aatcgcaaatcatgataaaacagacaaagtaaaattaatttcattttcaatttcatcgagmtcaaaaaaattatagcctattctcactggtgcccacccaccgtcctgaatcaagggagga

SEQ ID NO: 2074 - DNA, 121 bp, Gadus morhua
ttcaggagctctgtcaagaagggtgaatgaaagcacaaaggacatgtcgtcctgcgttatstgtccacacttttatgatcccgataagcaggttttttttgcaatatttgtcgcccggttg

SEQ ID NO: 2075 - DNA, 121 bp, Gadus morhua
gatcaacgttttgtttgaacccgatcctaagacactaaaaataaacatgaaccttaatctsaaaatagaatatgaatttgattacgattacatttaatgtttttaggtagattaagaatgt

SEQ ID NO: 2076 - DNA, 121 bp, Gadus morhua
gatcaacgtatagtttgaacccgatcctaagacactaaaaataaacatgaaccctaatctsaaaatagaatatgaatttgatttacgattacactttaatgtttctaggtagattaagaat

SEQ ID NO: 2077 - DNA, 121 bp, Gadus morhua
tacgcccctgtagcgtgccacacaatccacaatgccgagatagttcagggacccatgccgwacagtgctttcgattgccctcactccgctgacgtcttctagcatatgagagacgctatca

SEQ ID NO: 2078 - DNA, 121 bp, Gadus morhua
gcagggtttgccgatcttcttctcgaactcctctccctgcttgacctcccgggggtagccrtcgatcaggaagcccttggacacgtcagccttggcaatcatcgcatccttgatcatgtcc

SEQ ID NO: 2079 - DNA, 121 bp, Gadus morhua
taccatttgtagttttccttgtctaagttttttttacatattcagacagacagaagaattrgaaataaatgaataatttaacatttggtacccgatagcttgaacaacagcaacataaatc

SEQ ID NO: 2080 - DNA, 121 bp, Gadus morhua
gttataaaattaattagtatcatttgtacttgtaaacaactaatactgattcaacaatacmtcacaataaaacaaaaaaataatgtttttccttgtgttaccttgtgtttatgatttgcaa

SEQ ID NO: 2081 - DNA, 121 bp, Gadus morhua
atttatccttcaacgcatacaatgacagtagtggtagttgtaatggtggtagtagtagtgycagtagtagtgggttattccctgctagacacaggactgataccgctgatcgagtcttagt

SEQ ID NO: 2082 - DNA, 121 bp, Gadus morhua
ttggaatggaaagcggttagggatttgtatgctagccatattccgctaaatgtcaataatmagatgcattaatagctccaataaatccagccaaatcaccccaacaattgagtgacacagt

SEQ ID NO: 2083 - DNA, 121 bp, Gadus morhua
gttacccactgttagaaaacaggtcctttctagccagatgtgcctgtaaatgcacggtgcmaagaacgccagcttcgactgccattacagattacagttcatgattcctcacaaaaaaaaa

SEQ ID NO: 2084 - DNA, 121 bp, Gadus morhua
tatggttttttaatgtgaaattactgactamttctttaaacaattgtttagattaaagtgwcttccgaattcatggcagcaaagcttaaagtagcataaatggtaytacatttgttggaaa

SEQ ID NO: 2085 - DNA, 121 bp, Gadus morhua
acaaacaaaacggaccactaacaaatggtccagtcaagacggatctaaagcagcactttcyccccctggtgaccaaactgtaggattacagtgtcgagtggtaggtgctcgggacattttt

SEQ ID NO: 2086 - DNA, 121 bp, Gadus morhua
caagggaacagtattaactattagttagggctagtgttagttaattagtgacaagaacacrttgcatacactttttttccatgtttattcagtaggtgacacaaaacttaaaaccgtttta

SEQ ID NO: 2087 - DNA, 121 bp, Gadus morhua
ttaattatgagttttyttaacttgcttttttgtaagtgcgcatataaacggcacttgggasaagcgaagctcttctcacaggcataaacatcctttttaagaacaaaaggagcactgtata

SEQ ID NO: 2088 - DNA, 121 bp, Gadus morhua
acaagaaaatgtaacaaaagctgatatctactgcaggattttcctgagaattgcaattaaktaactaataatagattttggctttggcaaaacatctcatagactattctttataaagtta

SEQ ID NO: 2089 - DNA, 121 bp, Gadus morhua
atcaattctttatttactgaacagtagcacagctgtcatcgacctttgatctttcctttaraaaactaataagggttggatataaatatataaacaattggcttcataaagtcatcgtcaa

SEQ ID NO: 2090 - DNA, 121 bp, Gadus morhua
taataagggttggatataaatatataaacaattggcttcataaagtcatcgtcaacagtcrgggtatccttaggatttggatactgaatggccgtcagacagttcctcataggctaatatc

SEQ ID NO: 2091 - DNA, 121 bp, Gadus morhua
cacaaaaggcaaattgtttaataaacttgaatatctggcatcaaagacacattcattgtcmaataatattttttaacgacaatcacacatcacatcaaatatttatattccatatgtaatt

SEQ ID NO: 2092 - DNA, 121 bp, Gadus morhua
tgcacacattagaaaaattaaatgcttccaaattatagacttttaagacaactagattttyccttggccttcctctacgtacgtcctacttttcctgacgtattgaggcctatgtctgtat

SEQ ID NO: 2093 - DNA, 121 bp, Gadus morhua
tgtggcatcatggaagcaaaaatgacatctcactagctctaaataatataatgcaatcacrattgaaaaaataaaatagcaacataccaaaatactaacatcaataaaagtgaatacaagg

SEQ ID NO: 2094 - DNA, 121 bp, Gadus morhua
tcaggtatcattagaataagagataaacccctaagaagacatcctaatggttcattaggawgaggaggccgcctctatcccctccagtgtgtccaggatggacgggcccttgtagtcgttg

SEQ ID NO: 2095 - DNA, 121 bp, Gadus morhua
ctacaataacatattggtgacctgattcactcttttcccagcagtgattagcgatgatcamgaagaccatgatgttcactgccagttcatcaccgatttggacgttcataccttcatgttt

SEQ ID NO: 2096 - DNA, 121 bp, Gadus morhua
tggcgcagtactccatgaagttcaaggtgccgtccttgtctgcgtctaggktcttcatcakgcaatcaagcatttccttcccgccaaggtgaggcagttgttcttccaacagctttgccaa

SEQ ID NO: 2097 - DNA, 121 bp, Gadus morhua
atgatgtgatgtgaaatgtgaaatcaaaaacagttttcttgttaagcaaaaaataattccmgtttcatgcacataaatcctttatatttgtgttattatgcaagcaacctaaacatttgaa

SEQ ID NO: 2098 - DNA, 121 bp, Gadus morhua
atgtatgaacatagtactggttaggcaggaattagcgacatcgtcatcagtggtgaccaayagcaatggtccttggtgcttgacctctctgtgtccgtgcagctcagtcctactgtctcct

SEQ ID NO: 2099 - DNA, 121 bp, Gadus morhua
aacgttagatcactcgttcagtgcacgacaattaaacggagattctaaaatcaagcagagmtaagcagagttaattttttcatttttttacaaccattattgaacgtacaaatgcgagaat

SEQ ID NO: 2100 - DNA, 121 bp, Gadus morhua
cctaatttgaaattctgttcaccatttaatccattcaagtagtttcattggttaaaacccmaaaaagataaaagcttgaatttccatggcagacgaggactcaattgtgtcactattggtt

SEQ ID NO: 2101 - DNA, 121 bp, Gadus morhua
cccgaatgggtgaggatttcttcagtttacaaaatattttagactttccttccayccattrcagcactactagcacgttgccatgttgttgaattagcttttggcttacgtctctgtagct

SEQ ID NO: 2102 - DNA, 121 bp, Gadus morhua
ctttgctttctttgttaaaatctacttgcacttgcaaaaattaccctacaggaggaaaatkaaatatcccttttcccttctttgaaacaatcatacaacaattatacatttgattcagttg

SEQ ID NO: 2103 - DNA, 121 bp, Gadus morhua
attccccatcagtttagtctatggcgcactctaaaggctgtctaaatactagcaatttcakaagatatgagctagtagcctccttcatggaaaccagacgggagatatttgcaatttatga

SEQ ID NO: 2104 - DNA, 121 bp, Gadus morhua
gtttgtacatattcacattaatgttgaaactttgcccaaaagattatgatatgtgtaggcrgaaatgcacctttgttgggccttttggctcacactattaaaactgcacttaaactagacc

SEQ ID NO: 2105 - DNA, 121 bp, Gadus morhua
gaggtactggggtctcgattgtggcttctgctccactgagatcgaccgtctccgcgcaacycaggaaacgtgctatgtgtggctggcaggaggtagggtcggcttggttttcccggaaaca

SEQ ID NO: 2106 - DNA, 121 bp, Gadus morhua
actggtgttgggcaaaagctaatggtccaattactgagcttaaaaaatacaatgcttttcrcattgtttctccatcattatattaatcttccaatatctgccattatcccagcaagactga

SEQ ID NO: 2107 - DNA, 121 bp, Gadus morhua
ttatggcattaacccaagaaaacactcccggactgaggcaacgcgcgctatctgtcagcargcagctaccacgagcctcctaccgccctactttgaagcaatgtatcgttaaacccaacga

SEQ ID NO: 2108 - DNA, 121 bp, Gadus morhua
aagaaagccatttgggaaatccaagtctagtaggaaacaattatttctattaaacacatgkccatatcagacttttagacaatgtatggaaaatgaaagtgtgctgtaaagttccattgat

SEQ ID NO: 2109 - DNA, 121 bp, Gadus morhua
tctacagcaatctacatttcatgtttgaacattagcaagttaaggattgtatgagtagtasatagtattgccacacacacacacacacacacgtatacatagtaagtcggcgacctctagt

SEQ ID NO: 2110 - DNA, 121 bp, Gadus morhua
acagtgaggaaatatataagcacaccgctatcatgcaatctggtaatcctcagccatcttrttgagccctgcaagcaaattaccttagtgactagtgagcaaattttccactttcaagttt

SEQ ID NO: 2111 - DNA, 121 bp, Gadus morhua
taaaaacaacctcaacgcaaagaaaacaacaatgacaacatcagggaatatatatcagcgyaacatcaataaataaaaaggcgagatgatataggggttcaaacggctctggtaaaagaaa

SEQ ID NO: 2112 - DNA, 121 bp, Gadus morhua
accaattaagaagctgccgccactccgaaaacaatttcaaggacttccgcggcgcatatcwggtcatgatctctcgctacagctacgttaacggtacagcagggttatcggagaatgacag

SEQ ID NO: 2113 - DNA, 121 bp, Gadus morhua
tcatgcggctacactttactattggtgaaaaaacagcattagtgtttgcgtcgatcacacrtaaaatrcccaattatgttacatgaaagagttgtatcagatgaggataaataataagacg

SEQ ID NO: 2114 - DNA, 121 bp, Gadus morhua
cttagaagcataacactaaatgctgtcataatatgaggaccagtagacgtttgttaacccrgtccacactatagctacactgtagtaggcatagtttcttacctcttattgggacccatac

SEQ ID NO: 2115 - DNA, 121 bp, Gadus morhua
agaaaacattaaattaacgttttttaaggcatctgttaaargttggttaagtgtccttagygtttaactggaacattccaggctggttcttggagtctatcaagttcagcagctctctctg

SEQ ID NO: 2116 - DNA, 121 bp, Gadus morhua
cacttatattggccagctgggttttgtttcggacaataacagatttatttaaaggaggtgytatgttaccaaatacagcaatattagtggttgacggtcaaccaaaacaaacgattaaaaa

SEQ ID NO: 2117 - DNA, 121 bp, Gadus morhua
aaatattggcgacaaatatcaacaccgatcattttagtatatccattttacaatatgcacrtattataccatcgtggactagtgttgcatagcttgtactcagtggtcaaacaattatcga

SEQ ID NO: 2118 - DNA, 121 bp, Gadus morhua
agacatcgttttagtttagatctcgctccagagttaggggaaaattcatttttggttcccrtcctgtggcatccctggcacagcccaagccgatatacagcgaagcaaatgatcacctggt

SEQ ID NO: 2119 - DNA, 121 bp, Gadus morhua
atctctatttttcccttgttacactcggcctacaacatatcactttgcaatgagaaagacygaaaaataaaaatgacaacaataaattgttaaaaatgtgtacatttggtcaaaataataa

SEQ ID NO: 2120 - DNA, 121 bp, Gadus morhua
atagcactgggctcttgaagctccgcctccacaccatttgaaaccgcctttcagatccamygtgcgactgctcctggaatttatagcaaagtaattcctgcccataggttccgatcagcac

SEQ ID NO: 2121 - DNA, 121 bp, Gadus morhua
ttgagcaaaagaacaccacacagttgtcctctgccttccctttggactgaagctacatgcwaccgtgcatgccaggctcgattttcctttccttcctctccctcttcactttgaaccaaag

SEQ ID NO: 2122 - DNA, 121 bp, Gadus morhua
ggatgggaaaacagcctctctcccatacatcatgaggaaaggactgtgtttggtggtggtytggaccttcgaccttaatgaaaacaacgtaagcttccaagaagacatcccagttgttctg

SEQ ID NO: 2123 - DNA, 121 bp, Gadus morhua
atacagttgaacaacaattgatacagacaaggatttaggatagcagagcctgaattccacrgaaaacaaatgaaccaggccacagaactcatgattacggataatggttcaagaatcctta

SEQ ID NO: 2124 - DNA, 121 bp, Gadus morhua
aatattgcttatcccacccacctaataatgacttgtctttgctcctgaagaaaccgttttyccaagagcacttgcattcacattagtagactacagaacaatggagatggtatcgccacga

SEQ ID NO: 2125 - DNA, 121 bp, Gadus morhua
gaacaacattggaaaacatgagtcaatgtaaatgttattagacaatatcggtaaatgagawagtggatgaacgttacactactgaaaatatatattggcaccccagcagttggcttcactt

SEQ ID NO: 2126 - DNA, 121 bp, Gadus morhua
aatctcttgtagtatctcattctcctcaatctcactgtgatacagcagcacccgcagaatrctgccaaccagaggcaggcatgaacccatcgggctgttccactggggctggagcctgtag

SEQ ID NO: 2127 - DNA, 121 bp, Gadus morhua
tcaaagctatttaattaacatggggaaataatagttagcaaattatgtttttgcagcaggsaagtgagccttctagtctaataaagtgggggggaatcacaatcaaccaaatagcttgatg

SEQ ID NO: 2128 - DNA, 121 bp, Gadus morhua
atagagtttatgtcttgcattaaggagtgcaaatacatttctaaaacacacgtaaccactytagtgttagagctcatctggcagtttgacaaataaattaaatgaacatgcagcagtcgat

SEQ ID NO: 2129 - DNA, 121 bp, Gadus morhua
atagagtttatgtcttgcattaaggagtgcaaatacatttctaaagcacacgtaaccactytagtgttagagctcatctggcagtttgacaaataaattaaatgaacatgcagcagtcgat

SEQ ID NO: 2130 - DNA, 121 bp, Gadus morhua
taattaatctatttaccatctaaggttaccccttaacttccccccaccttaaaacaaagtyatttcattttgctttcaccaaaaactgtttaaatactatataaaaatcaattgcacagaa

SEQ ID NO: 2131 - DNA, 121 bp, Gadus morhua
taacacaaaaaaaacagacatagggttctataactgaagtgttttacrttgacttctttartaatagttggctgctacggtttgagtagcagggacttttggtgcgcctccattcgctttg

SEQ ID NO: 2132 - DNA, 121 bp, Gadus morhua
aaaatgtaattacaaaatgtgttaatgacccatttcttcttattaataaggctcagtcagkcggctttgtctacaactttcttttatattcattagtttattaagtggtgtaagtaggatg

SEQ ID NO: 2133 - DNA, 121 bp, Gadus morhua
agaacaacaccagcgaacaaacaaaaatcaatatcaaaatgcaggatgtaaaaaatcatartaacacttctcacgacacggtacgagtatcaacacctgtggtccaggagaactaaatgga

SEQ ID NO: 2134 - DNA, 121 bp, Gadus morhua
gagtatcaacacctgtggtccaggagaactaaatggagtgcgtttcacaaggtggcgtgcygagcgaggaaggcccggatcctctggagcagctccttcttcacactgtcggggactagcg

SEQ ID NO: 2135 - DNA, 121 bp, Gadus morhua
atacacaaactgacacaatggtcagtttgcaagagtagtataatgttaaaataaaaaggtkgaatgggcatctgtgctttgaaaataagtttgtatacttttgcaagaactgtaatccaga

SEQ ID NO: 2136 - DNA, 121 bp, Gadus morhua
gtatcatcgtgggatccacatcaggaagtgaaagaggaaggtaatccccctctccaagatwagaccgtgaaaactaggattcagagggacaagtttgatcatccgaattaatttgattccc

SEQ ID NO: 2137 - DNA, 121 bp, Gadus morhua
aatgatgcgascacgcaagtcccaagtccccagggagacaacagcgacatgaaaacacagsctaaccaactagctgccatggcattcacagacaaaaacaatgagtggaaaaaaaaagcca

SEQ ID NO: 2138 - DNA, 121 bp, Gadus morhua
ctcatgcgaacacggcggatgtacgttctctcccaggaagttcctgatctcgaccaacgcrcctccctgcctggatgaccatcrtgtgatggggaaatgggcgtacacagagcgcatcttg

SEQ ID NO: 2139 - DNA, 121 bp, Gadus morhua
ttctgatataccttaatattttgactatgtggtggcctgctgaatcagagccgctgagttrgacacaagctccacatcattgccctccagcaccaactcgtccttctgggccgtcgacaga

SEQ ID NO: 2140 - DNA, 121 bp, Gadus morhua
aaacttcctgatgtccttcttcttgacggtggtggcctgctggatcaaggcagctgagttrgacacaagctccacatcattgccctccagcaccaactcgtccttctgggccgtcgacaga

SEQ ID NO: 2141 - DNA, 121 bp, Gadus morhua
ctggacgtgactgcagatggtgcggaccgtggccaactcctttctgtttccccaccatttrtccacgcgaagcttcttgtttttctttcccaggaggctgagctccaggttgatgtggttg

SEQ ID NO: 2142 - DNA, 121 bp, Gadus morhua
gattaaaacaaaatctaggaatatttagatttaccaaagtgcattctttatttgagcactratgacttaatgaaagaacattcccctggtgagccgatgtgtctatagatgtgagcttatt

SEQ ID NO: 2143 - DNA, 121 bp, Gadus morhua
taatctggaacatttagatgttgaagaatgtgctggtttagttgactaccataaaaaaaamacttgaatgcattgtaagcaatgtcaggtctgtcaccatctcccatctgtcaccatctcc

SEQ ID NO: 2144 - DNA, 121 bp, Gadus morhua
tcaaagacaacaaatcattaaagaaaaaccatagaataatcttaaaaccggtggaaaaacraaggaaactctaaaggcctcgacaaccaagttgatgatcaagaataaaggttttgtagaa

SEQ ID NO: 2145 - DNA, 121 bp, Gadus morhua
gacatattacawcsagccccccgggggaaaaaggagaagaagtgaccaggactgcaccaamgtcctctcagcatcagccctgatgaggccagatgtcttttaaaagatgggatacatctac

SEQ ID NO: 2146 - DNA, 121 bp, Gadus morhua
aggccagatgtcttttaaaagatgggatacatctacagtttgaattcaatcagagccatcmctgccttgagaaggcccagtcgatgagcatcacgaggacaggatgatgtggaaygggtcy

SEQ ID NO: 2147 - DNA, 121 bp, Gadus morhua
aataaatagtgtttataagatgtcagaagatccgcgtgctgtgtgctaagaactgagcaaytgggggggtcccacgaaaatacgagggtaccatcaggtcaggggaaccagcagscagtcc

SEQ ID NO: 2148 - DNA, 121 bp, Gadus morhua
gggggtcccacgaaaatacgagggtaccatcaggtcaggggaaccagcagscagtccgtcrtgctccacctgctcagtagccagcgtatgtcaggtactgtggaccatagtaagagttcyt

SEQ ID NO: 2149 - DNA, 121 bp, Gadus morhua
aatggacactactcagcggtatcttcaaatatagatttgctttttacatagatttttttgygaaaaaattgtattttcaaaagttattgatagtgctttgtgaaaagaacccatgtacctg

SEQ ID NO: 2150 - DNA, 121 bp, Gadus morhua
gctccttccgacttaaatacaaaacaaaacttgaaatagcttctcccttacttctctccakctcctttcccatctcccatcgcgccctccctcgagtcatttaagatcagaggtggcagga

SEQ ID NO: 2151 - DNA, 121 bp, Gadus morhua
ctttcttttcgttctttttttttaatgtgcgcaagacacaagggacaacacacaaggaatygaggctgcagtgacataaaacacaacagcacaaaaggaaagctgcaacacttcagtataa

SEQ ID NO: 2152 - DNA, 121 bp, Gadus morhua
ggtaacagtgtttttatgaccacgccataaaaaggtttattaaatgatttgtttgcagtaraccaatggtttagtttaaattgcacttctttttttatctacatttggcaaacatctgaat

SEQ ID NO: 2153 - DNA, 121 bp, Gadus morhua
gggaacagacccaacttctcttacccaattttcaacacaattgcacacacaaacactccaraactgtattattaagtaaaataaattgccaacatttcacacttgaatatttaccctttgc

SEQ ID NO: 2154 - DNA, 121 bp, Gadus morhua
tcgaccaatttccatgtggcacagaatgcatcaaccattttggcaatatgataagtccgcytcagataacggttgaagtgctgatgttatagatagacgccctagggactccccccgggcc

SEQ ID NO: 2155 - DNA, 121 bp, Gadus morhua
gttccctcaggcatgtcacattaacacaacaattaggatttcctagtcccttaccttattyaagtaaactgtgttcaaactgtggacacaccgtctccagatggacacaacttcattcaga

SEQ ID NO: 2156 - DNA, 121 bp, Gadus morhua
gacattcagctgtactcagagcaacgaaggaaataaaacggttcccactattttttcttcktcatttatttataatacaaagagacgctatggttttaactctttcgttttccatccgtcg

SEQ ID NO: 2157 - DNA, 121 bp, Gadus morhua
taaatgtaagataaaatcttttgatttcaaacatgcatcgaagtgaaatgtaaaataattrtttgctttactgcaatcatttatgaaccaacaatgccatggcaccagatgtacagcagta

SEQ ID NO: 2158 - DNA, 121 bp, Gadus morhua
ttcgcctgttcatggtcaagttggaatgcctcagtgcattctgtaagcctacagtatacayctgcacattaacaattattttacactacattttataatatataacatcatagtatgtctc

SEQ ID NO: 2159 - DNA, 121 bp, Gadus morhua
tctcaataaaataaaagtaacaaattacaatttaaataaatataaaaccaataaaagacartgccagttggaagagcaaaaaccataatctatcgatcacaagtgcggcggctgtcggaag

SEQ ID NO: 2160 - DNA, 121 bp, Gadus morhua
tgaattttaaaaatggctaggatggcagagtcattgtgaatccgaggaggagtctttgacrtctgtgctttccgttgcctcgctgacttcactgagttccttgctctctcctccactgtcc

SEQ ID NO: 2161 - DNA, 121 bp, Gadus morhua
atgcgtatcactgaatccaatccagtggtacccttttttttgggtcatggttctctatcamcgtgttaaggaagttcatttcgtcagggcgatggayagagaccaggtttgcgtccaaaga

SEQ ID NO: 2162 - DNA, 121 bp, Gadus morhua
tgaaggctcggtaagcagacctgmcagggcgagggcgtgcaggccacacaggaraacggarcgcaagaacattgctggactctttcactctattcgagctgtgtctggaaatgtgtgtccc

SEQ ID NO: 2163 - DNA, 121 bp, Gadus morhua
atttggcagatggacttgggtgaccatgttattaacaaaaggagtgtgttgatgtgtgcgygtgtgtgtttcctcaaggttgaatgagtttgacgtgtgaaaagatacaacaaacagcggt

SEQ ID NO: 2164 - DNA, 121 bp, Gadus morhua
acaacacactgcatcttcctcctgggatataatggtcatgtcataattcctattaatgatrcaacagtcaacataattagattggacatctgaaatggtcagcaaggaatgggatggacat

SEQ ID NO: 2165 - DNA, 121 bp, Gadus morhua
aatgaagtacgatggtctggtaggaccaggctagacgctgartacttcagcagcttggagmcacattttggaaatgtgtactcaacactttgcagtcacttgcgaacacaaaattgccaca

SEQ ID NO: 2166 - DNA, 121 bp, Gadus morhua
atatacaaaaaggtaaaatttgaagtccccaagcacagattggataattgttcaaactatygctagcagaataatgacaacatgatggcggcctgtattgcagacgtttcaccggggggcg

SEQ ID NO: 2167 - DNA, 121 bp, Gadus morhua
cacgaatttggggccaattactttacagggtgccgcaccatgaggctgtgaaatccagcamcaacaagttgtcgccagcttctgccagggcagcctggaattcttccatgtcttcaatatt

SEQ ID NO: 2168 - DNA, 121 bp, Gadus morhua
atgcgtttacaaaaacatacaacaattcgtctgcctctcaaaaattcatttttttaacatygaaagaagctaatttatagtgttgttcccattggtaatattgaaaaaggtacacattttc

SEQ ID NO: 2169 - DNA, 121 bp, Gadus morhua
acacgctgaatacagtcatcacatacagtttttgcttgtgcttacaaaataagatcagtcrcattgtttaccggtctttagaagaaacagtgttatcccgaaagccaccagactattgcgt

SEQ ID NO: 2170 - DNA, 121 bp, Gadus morhua
tactgttgtttgcccatgaagtaaaacatttgcatcagaaaaggtgttaatctacacacaytgaggtctgctgttaaaaaaaaagaataatagaattcatgaccaaaaggaaatgcagtac

SEQ ID NO: 2171 - DNA, 121 bp, Gadus morhua
catttaaaaaacacatctcagtttaaatcagcaggatatatatagatatttaacaaaacgycaatctgaaacatttaaaagtctacatgtaattatccttgcacttaacaagtcgtcccat

SEQ ID NO: 2172 - DNA, 121 bp, Gadus morhua
cttgtggaggagattttaaacatacagtctggttatggggttctccagttctgaggttgtwatctgtggtttccattgcatcaaccaggtataggaggcccctaagtcatcctgggccact

SEQ ID NO: 2173 - DNA, 121 bp, Gadus morhua
aagtgcctttccaagaagttaatcaatctgaatattagcaggcattgaaacatttawtttsttcaatttattggtcacaggggcgggttactggctatagtgaaccatcatccctctgggt

SEQ ID NO: 2174 - DNA, 121 bp, Gadus morhua
tgactgagcgtctattttttctatgaaatgtttgaagtgcgtgaaacaacttgtatttctwcgctttctctaaaattgtatttgaacaaataaaaaaacaaattacctgacttgcggccgg

SEQ ID NO: 2175 - DNA, 121 bp, Gadus morhua
tcagcagtgcatatgtaagaagtatgttagccaagtgtggatttaatcctgattactagtrttgactgtatggataaagattgtctgatgatgtcctgggatctaaataatttaactattt

SEQ ID NO: 2176 - DNA, 121 bp, Gadus morhua
gttaactcagtccatagatggtcacttcaaagtccatatatggtcatgtcatagcccatayatggacatgtcagaccatatatggtgaattctttgcccttacatggtcgtttcatagtca

SEQ ID NO: 2177 - DNA, 121 bp, Gadus morhua
cgttaaatttgtttcatacaccctgtacacagtccacctccttcggctccggccaggccaractaaatactaggcagtgaaacctttttaatcctacatttattgtgcctaacagacacat

SEQ ID NO: 2178 - DNA, 121 bp, Gadus morhua
cacacacgcatacacctcattctcagtacaaacagcaagtctggaagggagaggacatttrggctttgaacctgaacggagcgaatgaacatcaccacctttgatttgcttttacttaaat

SEQ ID NO: 2179 - DNA, 121 bp, Gadus morhua
gttgaggcggagattcttgcggaggatacccaggtttgaaaaaagcaaacataaaccgaakgacagcagtagcacctggactaaacatgaacagaaagtcatacagagatcacataacgta

SEQ ID NO: 2180 - DNA, 121 bp, Gadus morhua
aaccttccacaatcaaatatccaccaaaatatatttaaaatgcatatcggacaataccgtktaatcaatgctatagtttatgcttaattttttataaaataaagatgcaaaacaatgacaa

SEQ ID NO: 2181 - DNA, 121 bp, Gadus morhua
cttcagcttctcggccttctccttgtctgtgatgaccaaggtgtacaggtacctgccgcarcgcaccttgaacttgacattgtccttgttcttcttgatcttaacggacttggcatccttc

SEQ ID NO: 2182 - DNA, 121 bp, Gadus morhua
attaacmcctcaaagctgwttcaatgagaggaagaacctgcaggcaaacaggattggtttygctaggcaaaccagccttgtgcaattttaacaaacttctcaccatctagtccactgaggt

SEQ ID NO: 2183 - DNA, 121 bp, Gadus morhua
acaggattggccgtcgggccccgccaatcatccgccaggtagcggcaggttacagaacackccatttacaacacacgtggagcaatcctcaagaaataaaagagaataaggtaaatagaga

SEQ ID NO: 2184 - DNA, 121 bp, Gadus morhua
aaaatacaagatggaagataaacaatggaaaatgataactaaaacactccaactacactaraataacgttgagttacacggactgcaccaaggtattctacagcagttatacaaccatcga

SEQ ID NO: 2185 - DNA, 121 bp, Gadus morhua
aatgtatgcayatacagcaaaactccctgatctggtccggacagcaaatgagctgcacagwagaccatatttggggaatgaaaaaaaaaaaaaaagcaatcatatcttatagcattcataa

SEQ ID NO: 2186 - DNA, 121 bp, Gadus morhua
tgtacaaccacatttctctcactttgggacagtaataatgattaaaaaaaaaagcctatamattacttctatgtgtaaacccctaaaaacttttattttgaaagtccacatttgttgtatt

SEQ ID NO: 2187 - DNA, 121 bp, Gadus morhua
gaaatctaacacacttgttcatacttcactgggcatacattactacagatattgtgttggyttacatgtcctggagactacataacagagcaaagagtgctggaatacaattctccacagc

SEQ ID NO: 2188 - DNA, 121 bp, Gadus morhua
ccagcgttattcaatttacagaatcaattcaacctgcaatatgccaccattttttttatgyagtcataatctttgtttatcataaaatacatgcaattttaatgtagagtataaatacctt

SEQ ID NO: 2189 - DNA, 121 bp, Gadus morhua
atctgttttgtagaatgtttcttctgaactactggaccgctttggcgtaacaaagtgacawgggggacaaaaagcagtgctgtgcttaattgcacagcatgcaagtcaaatttctgatcgc

SEQ ID NO: 2190 - DNA, 121 bp, Gadus morhua
agccatttactggcttcgttatgtatagtccacataaacagacagcagtgcattgagacarccagcccaatactatagtcttttgattttgagcttttggtagcattgcttcccagattgg

SEQ ID NO: 2191 - DNA, 121 bp, Gadus morhua
ttatctttgaacatttataattctgttgtcctggcagatgcgtgcctgtggacagactgtyatttcaaattgcccacatacatttataacaatggttttacattttcaacaactggataaa

SEQ ID NO: 2192 - DNA, 121 bp, Gadus morhua
caggcaggatgtctttggtccatacttagtgacaggagggggggggggggtgttaaatgaraggaagacmaggcactttagtttcagtttgacagtatagaagaaaagtgaaaagaggaca

SEQ ID NO: 2193 - DNA, 121 bp, Gadus morhua
tttgtaaaacccttccctcgcagcgatttccgtacagcgaaagccacagcagaagaccggyggaaggttgttaggggctcgtcttccaggtgacctgattttctggactaaccattagtgt

SEQ ID NO: 2194 - DNA, 121 bp, Gadus morhua
tccaatatttcccatactttacctctttaaagctgttaaaaaaatatctgatatttcttarttctttcgatccctgtgttgacgagtacgtctccgatgaaactcttcaacattattgctg

SEQ ID NO: 2195 - DNA, 121 bp, Gadus morhua
aatgataataacatacattgtgatcggatacttttcaatctgattcacatcggcaattgckttcagttatatatagattgaatttcataaaaataaaactaattacccctaaataaaagaa

SEQ ID NO: 2196 - DNA, 121 bp, Gadus morhua
ttacaaatatatatatataattgttctactcagtgataacaacagtgataaggtgtcagayctacttcaggtaatacttcaacagagactgacggggagacacgcgcaaacatttcaaaac

SEQ ID NO: 2197 - DNA, 121 bp, Gadus morhua
accgaagaataaaacaaagcattcaattattcttaagaacccataaacaagcactgacaargtaaaagatttccgttaaaaaaatctatacagagatatgctatccatctgctctgttcac

SEQ ID NO: 2198 - DNA, 121 bp, Gadus morhua
ggtgatcttcttaagcttgtcggccacctgggtcttggacatcttcttgttcccctcaatrccgctgtcgtctttcagtttctgtcgtctctccttctccttgatcctcacatgcttcacc

SEQ ID NO: 2199 - DNA, 121 bp, Gadus morhua
ggaacagagccaccatccgggcttccagacggagaaaagtgcaaatttaacaacgatgacracaaacatcaagggcaacggagacgcggatgagggcctgtcatcagtgtgtgtagtgtgt

SEQ ID NO: 2200 - DNA, 121 bp, Gadus morhua
gctggttaggcyggcctttagcccaaaacctgaagccatagaaagaaacaggaagagatcyccacaataagagccctgatatcacaacaacacacacagcagaaccaaaccctaacatggc

SEQ ID NO: 2201 - DNA, 121 bp, Gadus morhua
gttgtggaatgttctgaacaacatttaaacaaggctttttgaacaccttcattagaaacawaaagtcatagagattggtaaaatggatttacacacagggggaagaacccagcggcatggg

SEQ ID NO: 2202 - DNA, 121 bp, Gadus morhua
tcccgactttaaatcacttcttaaaaggcatatcagttaattggaacaccaattcaggagwagctgatgcactagggggcgccaaaggtactcaaatgaaactcaaccaacccagggccat

SEQ ID NO: 2203 - DNA, 121 bp, Gadus morhua
actttttgatttattcaaaagaaataaaggaaattacaaaaatactaaacataaattgaaygtcaaatcatgttttaaatatatgtcaccaacccaaaaaaaaaacaagtccagagtttca

SEQ ID NO: 2204 - DNA, 121 bp, Gadus morhua
cgaccggccccggcccgcctggcaccccatgatgactgcaagacccagagcgccgagaccraaaacagcacaggtcgatcccgcctccaccttggcagtgttgagagcggctccgtaagcc

SEQ ID NO: 2205 - DNA, 121 bp, Gadus morhua
aaacataagcatcattcaaagatatctgcatgtacaaccctgttatctactggccggaggwcaccataaratcaaactgtgttttaatggcggtcctgacaaaaatgactccctgttaacc

SEQ ID NO: 2206 - DNA, 121 bp, Gadus morhua
tggtccttcactgttggcgaaacacaacatgcattcattcgaataarttgtgccatcggtwccacaaaccggctcatattcacgtgtacaaaacggtaacgtatattggtcacactgtggc

SEQ ID NO: 2207 - DNA, 121 bp, Gadus morhua
aacacgtccagtcaagctaactatggaacaaaatatttttgtatacagaaacaaacataayaacataaaaacgtaaataataaggtcaatttactgaggcatgattcctaaaaagtcttca

SEQ ID NO: 2208 - DNA, 121 bp, Gadus morhua
catcgtgtctatcacctaggaatgtagtcacacagaggtattgatatatattgttccagcycacattgcttggagaagcaatatgtaattaatttagaataacgaaattattcataccaca

SEQ ID NO: 2209 - DNA, 121 bp, Gadus morhua
ttccacataagatcaggaacatgtttggaatggaaagcaatatgaagcatagtagcaaatyatgaatcaattaaaagtctgttttaaaaaaggcttaaaaaacactgtccattgaacatgg

SEQ ID NO: 2210 - DNA, 121 bp, Gadus morhua
ttccgacggacaataagccatccgggtggtaactctgtaacggtccgagtgtaattgtagyaattcaacccatgtacaaaaaaagaaaataaagaatgaaaacaaatggagtagtgtttta

SEQ ID NO: 2211 - DNA, 121 bp, Gadus morhua
tgaagggacatgtgaaacgatgattgggaaatatgaaaaaataaaacaagaaatcatcacktaaaccattgtactgcagacacgattgatttcgattttggtccccctagttggagagaag

SEQ ID NO: 2212 - DNA, 121 bp, Gadus morhua
cgggccaaaccaaactcgtttggcccgcattcactgccgttgtctggctacaacgctggaraatagcccagagttgttatgaacagcgaccaatkgaaactatcctggcgtgttcacagtc

SEQ ID NO: 2213 - DNA, 121 bp, Gadus morhua
ttatgaacagcgaccaatkgaaactatcctggcgtgttcacagtccaggagccagaatggsccctgccacagtttgctgatcctcctcctcctcctccgaaagtgctcaaataaagagtcg

SEQ ID NO: 2214 - DNA, 121 bp, Gadus morhua
accaatgcattcctttaattacccaggaatatttccatatcaagaggaaaggtatgaatgwaaaaaatataaccaggaaaaacagagggttgaaatcaaagccctctgttttgaatgttgc

SEQ ID NO: 2215 - DNA, 121 bp, Gadus morhua
gggaaatgatgtgcaggtgacagcgttttacaattaatttatgctcacatttgctgtgaaygtcgcgtcggccgacaggcctcatgtcagagctgtgtgtaccatggtgaacgcggaggaa

SEQ ID NO: 2216 - DNA, 121 bp, Gadus morhua
cttccctcccgttgggataccaatgaaacacaattcatgaaattttgtgaaaatcatcatsataaaaaagtgcagaggaacaccattaaattgcaacatcgaactttagtgtgtgccctaa

SEQ ID NO: 2217 - DNA, 121 bp, Gadus morhua
tcaaaatgtgtcgtycgcattcaaggtgcaaaatgacgggacaaaatcccagctccacagytctaaacttcatcaacgcacggcagccagaacgtcatgttagtgcaggcactggcaaatg

SEQ ID NO: 2218 - DNA, 121 bp, Gadus morhua
gtacacaaaaatctgataaaaaagaaaattcaacaaaatggtttgaaatcatattggaaargctcaagtttttcagtcaaccaacaacacatcaaaatgtgtcgtycgcattcaaggtgca

SEQ ID NO: 2219 - DNA, 121 bp, Gadus morhua
aaagtgcgtaaaaaaaaagacatcaatcttgaatgtcactaaatagtgcaacattattccraaccattttatgattacatatatatcaatgtttctaaaaatatatatagaaattatacaa

SEQ ID NO: 2220 - DNA, 121 bp, Gadus morhua
tatgcaactaccctactctacagcatacatctcagaataaaacagcactgtaaaaaatatwcggttcaccattcttgaacatttacatcaaccagcatatgcactacatattcatgtgaaa

SEQ ID NO: 2221 - DNA, 121 bp, Gadus morhua
agcatatgcactacatattcatgtgaaatgtcttgttttcctttagatgtgacaatacacwgataggaaaccggtaattagatgatgttcaacagataacagacatttgtaatgttgacat

SEQ ID NO: 2222 - DNA, 121 bp, Gadus morhua
atgagttaataaagataatctattttacagtggagtatattaatttgctaaagatgtgtgytgtaggtgtgtacacatgttgcaggtttgtttctaaaaccactgagctgacttcattgaa

SEQ ID NO: 2223 - DNA, 121 bp, Gadus morhua
tatttccagtttactgctctaattttcgtagtacttcattggttaactgttggctgtaaargtttattttcaagtgtccaggcatccaccccagcaggaaacgatcgaagtctgcccatgc

SEQ ID NO: 2224 - DNA, 121 bp, Gadus morhua
tgggtccctctccgttcacatggggcagtcgtagatgtggatggcgcggtcgtcgcctgcwgagatgatcttagagcctgtgttgttgcacttgacgctccaaacctggtcttgatggtcg

SEQ ID NO: 2225 - DNA, 121 bp, Gadus morhua
ttgcttcgttccaacagattctacaagcgaatcgcttcccattgcaagaccagtgtccatmtccatttgaccagtgaccatctccattcgaccagtgtccatctccatttgagcggctgaa

SEQ ID NO: 2226 - DNA, 121 bp, Gadus morhua
cctgtattatgggttggatagtgaggtcccttcatgagtaactttttttcaattgattaarttgaagtactagcaagtcagtctctcagataatctagcaagaatcgtgaattcttcaagc

SEQ ID NO: 2227 - DNA, 121 bp, Gadus morhua
gaaaagaatgtggatgatgaaggtggacattagaaacccaacattttgacaaaggcgagcragcagatgggcgcgaagcatagcagcagtgagcaacatggtagcttcagatccccatccg

SEQ ID NO: 2228 - DNA, 121 bp, Gadus morhua
tggccctcaaacgatttaaacgaccaccgaccggatgggtgtcggtcctacacctcgtcaygtccacacgctgctcactccctcggacacacgcttcagttggactcccgtcttcagttgg

SEQ ID NO: 2229 - DNA, 121 bp, Gadus morhua
gagtcgcccyggcaggaggatactccagaggctccagcgcagatcatggcgtcggtaatcytgttctgaccccagtactggcggcactgagtgctgctgagcagggggagggargtctgct

SEQ ID NO: 2230 - DNA, 121 bp, Gadus morhua
ttaatattatcagtagcactacatgatcactaaagtaagattgtacatccttatgcatgakagaactataatattcattgttttccaattcttctcatgtatagaatacgttcgttacagt

SEQ ID NO: 2231 - DNA, 121 bp, Gadus morhua
cttatgaagaaagcattcacatttaactttattctttatttttaggttaytgcagacactraacaaaaggtaggctattcctttcacatccactcaaagtaagaacaaaggtgaaagtaga

SEQ ID NO: 2232 - DNA, 121 bp, Gadus morhua
catagtaaaacgaccaggatataacacgttcctaacactatcactggcaagttacacctaraatgttatagggggtctaactggagcggactgagcgaccgttaaaacctcacagccctag

SEQ ID NO: 2233 - DNA, 121 bp, Gadus morhua
aagaaaataaagtctaccgacatctgcaaccgctgtgtttaggcctatcactgacctgctyaccagacgctcaggcaatttagattgggagttgtgtctgaagactttaaaaagaaacacc

SEQ ID NO: 2234 - DNA, 121 bp, Gadus morhua
ccgaagacatctccttccacgcctgcaggtcatgtgggtacgtcctgttttccgtcgaagyaggtgaccgcacaggacagcaagggcctggtcggtcggtcacacctgtagttttccacta

SEQ ID NO: 2235 - DNA, 121 bp, Gadus morhua
gtccgccttcagggcgggcaggaacagcctcagcacctcgggattggctagcagctcgggrggcgtgccccctatggagctcagccattggaggaactcttcgtcagtcaactcactcctt

SEQ ID NO: 2236 - DNA, 121 bp, Gadus morhua
agtttttatttgaagccaattacaataaaatcaaagcaagcgtatccaatcaccttgcatraagtagattacaatttaaagtgttcaattgcctaaaacaggtccctgatttcaaaaaaac

SEQ ID NO: 2237 - DNA, 121 bp, Gadus morhua
gccttaggcctagaagcactggcgttttggtatctttattagggtgccaactacaaagtgygaaggcaacctattgtaattgttagtgtttttattattattagggtgccaagcacgaagt

SEQ ID NO: 2238 - DNA, 121 bp, Gadus morhua
cccagaacaaagacctgatgcaggccaagagtgtttaccgacgacagatttatgacataayacttttgtcaaactattaaagctggtctccatggtctgtcttcgtggagtattgggcaga

SEQ ID NO: 2239 - DNA, 121 bp, Gadus morhua
tttgttggtttacacattttgcttatagaagcagctaaaagtggtttgcaggagacaggcyaatgtttattattatatttagctgaagttatagttaagcaaataacgtttatcattatta

SEQ ID NO: 2240 - DNA, 121 bp, Gadus morhua
cttttgaattccagacgtagacatgagacaatagacataacatacaaataaagtacatgamaccaaatggcaaaaaacttgccattcaactgtttgtacacgcacaatatatttgtgcgtc

SEQ ID NO: 2241 - DNA, 121 bp, Gadus morhua
ccattcaactgtttgtacacgcacaatatatttgtgcgtcttaatgtgttcacacaatccracgtttaatcccattaggtgaaccaggtgggtcgtttccttgctctctccactatcctct

SEQ ID NO: 2242 - DNA, 121 bp, Gadus morhua
attggagtgcgtgtattgtggttgaaatagtatagagaactgcagtgaattttgtcaaatrtgtaaataaaaataaaaggtgctcaaatggagcagtactacagtttcctcatacaaagca

SEQ ID NO: 2243 - DNA, 121 bp, Gadus morhua
tatcttaaaggggacatattatgaaaacaacacttttcctgggatttggggtgttwwattwgggtctctggtgctcccacaagcatgcaaaatttgaagaaagtccgtacatgatttttcg

SEQ ID NO: 2244 - DNA, 121 bp, Gadus morhua
actatttacgtttttttaatccaatgttcattgaataatgttgtatcaaatcccacaatcsatttacatcatttttttagaactgggaaataattcaattcttacataatgaggtgaagaa

SEQ ID NO: 2245 - DNA, 121 bp, Gadus morhua
attgacagctgatattgttagctgaattgttgtcttgtaaaaaataatttgtaagaatgcracgtcaaaatcctagcaggtatccagacaattttggtgacaatactgattccagaaaatg

SEQ ID NO: 2246 - DNA, 121 bp, Gadus morhua
ccagaagaattgcgaactattaacgttattttttacaaagctttttgtcctccagtcagaraggataaaagccgggttaacatattctcagaaagacaactagcaacaagagacagaagcg

SEQ ID NO: 2247 - DNA, 121 bp, Gadus morhua
ttcgaaatctaccttgtttttgaaatctacacctgtggaccgtaaaactttcagccggcgyccgcagtcgacgtctgacgccgaagcacagagtcctccgggtcttctttcttaccgatta

SEQ ID NO: 2248 - DNA, 121 bp, Gadus morhua
gggagcttctttgtgtgccaacggctggtgacacccttgtaatccgtgtcccttggtgacwccgatgacgtcgatcatgctcgtcctgggagaacacggtggtgatggccaccgactgctc

SEQ ID NO: 2249 - DNA, 121 bp, Gadus morhua
agtcaggacatgtgttgacattaggattttattggtttagataataattagaaagcagtcyctcaacatgtttccaaccgggaaatgaatcattttcattcggtccaaagccctttcaaca

SEQ ID NO: 2250 - DNA, 121 bp, Gadus morhua
attggctgttcttcatacaatgcatcctctccagtgtttggtcctcatcgatagacaaaawaaatcagatttagtcgaccagtaattcaatcatctcatgaatatcctaggtgtcaatagt

SEQ ID NO: 2251 - DNA, 121 bp, Gadus morhua
catctcatgaatatcctaggtgtcaatagtgccactcaggctctgaaccatcaagcagctycaagggtgtccagaagagtgtggcagatgttggtgatggcgctgaaggctgcgctctctg

SEQ ID NO: 2252 - DNA, 121 bp, Gadus morhua
gtagtgatcaatcacagtaaactaacttaattcaaacattgagtacaaaaaagtatcactwaatacacatttttattaaaaacatacaaatgctttgtgccagacattcgtcaaaatctat

SEQ ID NO: 2253 - DNA, 121 bp, Gadus morhua
cacgtttaatccctgaaaaacaaagcgattcaggctgtaacaaagtctaatttattgcacytagcgaggtccacagacgataaaaggattaacgagtcagggagaagatgaaggaaggcag

SEQ ID NO: 2254 - DNA, 121 bp, Gadus morhua
attacagtacttttggtcagttgaggaaaaaccataacaaaattggcaattaagaaaaaamtatcgatgatttgttatttcgtttgtagttttgtgttttttatcatattggcgattgaac

SEQ ID NO: 2255 - DNA, 121 bp, Gadus morhua
agtattaaacgtcatgtgaacatatggtaccgcagcccattatgtgaaaaggacaataatktatgagctataaacgaaatctagactataaaatgcaaatatttaggcagaccgagaaggg

SEQ ID NO: 2256 - DNA, 121 bp, Gadus morhua
tgcagcgtctcagaggtcttccgtcacagracatctggagcatctgaacacttctggaggyacgaacagagaggcggcgccggcggctggacgctctcctcaggystggttctcacagatg

SEQ ID NO: 2257 - DNA, 121 bp, Gadus morhua
ctggacacccctcattaccttcggggtggattgagtcggtgtacccttaactgacacaacyctttcctcgaggtacaagggctcctggttgggagacccgtcaactgacggacatggatca

SEQ ID NO: 2258 - DNA, 121 bp, Gadus morhua
ttacagcactgaatcaacaaagggtcgcagggaattttaccatttaaataaaatcccaccrgcgacatcctatacaaagttaagtcagagcctaggtattttggattatccgaccgcaccc

SEQ ID NO: 2259 - DNA, 121 bp, Gadus morhua
aagacattactttttgaggtcatgtttacataacaacacaaaagtatcccagcatagcgcrtgtccaggaacctgctcatggaaagataaaactggtttgtgaatccaaaaatattcacgt

SEQ ID NO: 2260 - DNA, 121 bp, Gadus morhua
aaaatattcacgttcttgaattattccataataccgtattccacctgtacggacaattttstattaacagcatctcttgttccaaccaataggacaccagattccctcctaagcaatattt

SEQ ID NO: 2261 - DNA, 121 bp, Gadus morhua
tgtgtgtgttgtcgtggtgtaggtatgtgttgtgtgtgtccggcaaggaccagcttctggycctggggccaatttgtgtgtgttagtcctgcatggaaaaacttctggtcctggagccagt

SEQ ID NO: 2262 - DNA, 121 bp, Gadus morhua
cccgtgtttaattgatctatctgtaatccaaattgatgcaacatttctgttctagcactawtttctccttatcgtattgtagtttggtaatagctatgatctgagctctggctgtgtgctg

SEQ ID NO: 2263 - DNA, 121 bp, Gadus morhua
aatatattactcttgatataattcaacttcggaaccacaactgttctgaaatttaggaagraacaacaaaaataacttctgttggggctgtatggttcatgtgcaccagtattataaactt

SEQ ID NO: 2264 - DNA, 121 bp, Gadus morhua; identical to SEQ ID NO: 188

SEQ ID NO: 2265 - DNA, 121 bp, Gadus morhua
aattatatcaaaattcaacacgaaaacaaatcgaacacaaataattacattattaaattaraagaatacaacctctttgtttagattaaaagatacaaaaaaacaacaaggaaattatcga

SEQ ID NO: 2266 - DNA, 121 bp, Gadus morhua
cacacatactgacgaacgcatggcacgcaaaccctatagtgcaacgagatcctttggcagyaagactagatcaataacagcccacacattttggggactactgtccttggtcagttttttt

SEQ ID NO: 2267 - DNA, 121 bp, Gadus morhua
aattacaccagtgaccagagttcatgagagatgcatgaaaatatcgtccgtttctatcccytccccaaacgccacagcacataaccatctcagaacgttacagaatgtcttgtaaactcaa

SEQ ID NO: 2268 - DNA, 121 bp, Gadus morhua
aactgtagtgcaatcacatgacccaatattgattaaaggtatatttgcatttgtgattaaraaaaatacaattctggcatattaatgcatcataaacataatacatctgtaaaatacatar

SEQ ID NO: 2269 - DNA, 121 bp, Gadus morhua
taagacaacaattggaaacttacaataaaatacaaatctttacatgtaatataaacatcaygtatgtgctgactattcgtcctataacccaaataatcataagtcccagaatattattaca

SEQ ID NO: 2270 - DNA, 121 bp, Gadus morhua
acaagtctactaaacaacagaagtagtaaaaaaaaaaggttaattaaaagttagttgtctkcaaattgattttgaataattcaaattgagaaatgtcaaagagcaaagcacttaaataaat

SEQ ID NO: 2271 - DNA, 121 bp, Gadus morhua
ttaaaataattgttggagataattaaccaagaatagccatgaattcagaagaaaggcgtgsagcagcacatgattgacatatagccataatgctaagagattaatacaaagtaaaggtcag

SEQ ID NO: 2272 - DNA, 121 bp, Gadus morhua
gccataatgctaagagattaatacaaagtaaaggtcaggtcaaaagacagaataatatttwaaacattaactgtatgcattcataaggggcatcagatttttttaaatgaataaacctcat

SEQ ID NO: 2273 - DNA, 121 bp, Gadus morhua
gagttggtgccatgggaatgattagacatgcatgcgccaatgcggctcggctaatggccgmaactttggagggttaaaatcttagaaacattgagccattacatttgttgaatatgaaata

SEQ ID NO: 2274 - DNA, 121 bp, Gadus morhua
gacaccacgtttaatagcataaaacgcataagacaatttacttgggtatttaatgatgtasgggggccgggcagatcatatattccttattatactccttagcttcttgatgtttggcaaa

SEQ ID NO: 2275 - DNA, 121 bp, Gadus morhua
ttgctgctatctcaggggctttggacaggaatactttgagcaaccatttcatatttkatcrgctggctagctccatctttcgacgtgcccgtactttgttcctcctgctcttgattttcat

SEQ ID NO: 2276 - DNA, 121 bp, Gadus morhua
atttaatttcctcattaaaaaaatatacaaaatgaaaaaatgatgcaccagtttagagtgmgactgctagatggttaatacagatgcaagctgagcaaaccaacaacataggtcaggaacc

SEQ ID NO: 2277 - DNA, 121 bp, Gadus morhua
tccgatttaaacagtgaatacccttaaatgaacccttatgataacctttatctgtgggctsaagggtctgtctgatggtcttcaaagagcacggccatctcatagaaagtacaaggacact

SEQ ID NO: 2278 - DNA, 121 bp, Gadus morhua
ggttaaaccattcacttatggattaaacgtgattacatcacaattcaatttattcattgcmagcctttggttcttataaacacagtttgccatactaaccagacgtactgtaacaatttca

SEQ ID NO: 2279 - DNA, 121 bp, Gadus morhua
cgcttagcaagttaataatatcaagatgctgtttcatggaacttcagtgttttgtttaatstacataactctttcacacgttttaatatgattattacaatctatctcacccaatatatag

SEQ ID NO: 2280 - DNA, 121 bp, Gadus morhua
tcattggtcatctgccacactaccaagagtgtattacctgtggttaggtgtgacttcgcarcactctctttcctcaagacttcataataccccaacctctggcactctccctatatcttct

SEQ ID NO: 2281 - DNA, 121 bp, Gadus morhua
atatgttttccagcatcagacgatattaacaaatggctagttcagtagtatagagatgttrtctttcagtaaaaaaagaagagattttggaccaatttgtacactaacagtttgagtgttt

SEQ ID NO: 2282 - DNA, 121 bp, Gadus morhua
cttgtggaaggctcacaaacgggcattgggatggacacaatagcactctgaaaacaaactkatagtgtgtttcaacacaagagcaactagaggcagaacatcattagtccaaaccatattg

SEQ ID NO: 2283 - DNA, 121 bp, Gadus morhua
ccggtagcactcggcttgtcggcagaacagctaacgcagaggccctccggccgtcatggcktccgctgtggtcggtccaatggctgcaaacttgatccgggtcagacgttcactggatagc

SEQ ID NO: 2284 - DNA, 121 bp, Gadus morhua
atttgattaggtcccctgcaacatgggtaaaagaactcacaggcgacgagggaaagtatgygcatgttgaatggactgaggggtgttgacgtcacagtagcaccttagctatcgcwgcggc

SEQ ID NO: 2285 - DNA, 121 bp, Gadus morhua
gtgtgtctcataacttgaccttgcccaccggaacagacagacagacctgtcttatacacamcatacatatctgccccygaacacacaaggtcctccaagaaaactattaattacttttggc

SEQ ID NO: 2286 - DNA, 121 bp, Gadus morhua
aacatccaaacatcttaaaataattttatatccgaggatattccttataaaaagtactgwmtaggaaaagagaacacattactatagtaatacacagctgtttagtccagrgtgataatgg

SEQ ID NO: 2287 - DNA, 121 bp, Gadus morhua
tcaatcacagtagcatggtagtagcaaaataagtaaataagcacaaaactaatgtttaaamaataaattcaggtataacacttagtaagaaagacttattttttccttgcagagcaccagc

SEQ ID NO: 2288 - DNA, 121 bp, Gadus morhua
cattacatatcgtttcagcaaatgcaaatcttaatggtgtactgtgaggtccctgccaagygtccatttctattactttacctttttaattcgtcgcatattttaggccacagtttttgca

SEQ ID NO: 2289 - DNA, 121 bp, Gadus morhua
agacaagtggaaaatgatactgtgcaattgaatccaagaaaaaaaatcaaaagaaagccarattaaaacacasgagtagaaaaactaatagtataccttttatataaaataataccaggtt

SEQ ID NO: 2290 - DNA, 121 bp, Gadus morhua
tggggtggtgtgtgtgtgtgtgtgtgtgtgtgggggggggggggggtataaaagaagsgamcttctaataatcactgtttcaattgacttaatatgaaattagttttaaccttggtaaaga

SEQ ID NO: 2291 - DNA, 121 bp, Gadus morhua
taataaggttttagtttgcttgtccacgttycttcgcaactctcgatgtcatatcgtttcwagcaagtcagtatttaaaaaaagaaaaaactaaagttaaacatgcaaacgtatcagtaaa

SEQ ID NO: 2292 - DNA, 121 bp, Gadus morhua
ttatgggtttacacaagatttactatatatcttacacaaaaatgttcagaatgaaaatagwtttaatacttatatgcaaatatatataaacgatattattagtcccgtttgcgttttattc

SEQ ID NO: 2293 - DNA, 121 bp, Gadus morhua
ataaatatttaatgatgtcggtcattgacaacccattctggcattacgaaaaactccaaamacaaakttcaccgcacgctttcctgcaggagccaggcgacgtgtcttctttcagagcctt

SEQ ID NO: 2294 - DNA, 121 bp, Gadus morhua
cccataaataccaggggttagggaggtccatcgcagcgtgctcaatccaggggccctgcarctgcctttcaggggcccgttcagcgcaaaggtgaaactgtggtgggacctcaaaacattt

SEQ ID NO: 2295 - DNA, 121 bp, Gadus morhua
tgcttgttcgacctaaatgccagaccactgtaccagtaagtacccttactggagaacaacmgtatccaattygtctctgctgggagaggtggtgttcagatagaagatttgttgacaataa

SEQ ID NO: 2296 - DNA, 121 bp, Gadus morhua
accttgaagccggtggggcaccagtccacraacttggatggwgccgcttggttcttgatgkttrctgatggccacgttgacgtctttgggcaccaccgtctccgcggtacagcaggcagca

SEQ ID NO: 2297 - DNA, 121 bp, Gadus morhua
aatatatatcctatatagtttagcagtacaatatatacatttctcttgcatcttgatattkgcatatacattacaactcttaccataccaataaatatgttaaatgaatatattaaaacaa

SEQ ID NO: 2298 - DNA, 121 bp, Gadus morhua
tcatgtatgatctcacgttgactcagtgtttacaatgagaaagtattcaccataaaaaaawwatatatatatctatgttwttacattattataaaaaatttaagcccgtccaaaggccaaa

SEQ ID NO: 2299 - DNA, 121 bp, Gadus morhua
taaatcgtaacctgggctttcagccgtggagctacaccgggagacatccatctcagcccgragcagggtggtccrctgagtcagcgggtcagccgatatcaaaccggaacgatttgtacac

SEQ ID NO: 2300 - DNA, 121 bp, Gadus morhua
aagtgcttctaagcagagaggcgtagaaccagcctcgrcagccaactcctccacgrcccckaagcgctccacacggacaggtttcacctgggaaatttgataaaacatggaagaagtctaa

SEQ ID NO: 2301 - DNA, 121 bp, Gadus morhua
taggaaaagggttattcatgtttctctttcaataaaaatatatacgataatatgtataaamgattaacaataataaaacctgtccacagatatcccccatcgatctatgcttaaaagaaac

SEQ ID NO: 2302 - DNA, 121 bp, Gadus morhua
tgtggagtttgggaccagaagtcctttgccagagaacgccacaatwgagaggtgtttgtawattgatgtcatgaaggactgcactatagccgttacacagcagagacccgtaaattgtaac

SEQ ID NO: 2303 - DNA, 121 bp, Gadus morhua
cccaattatgagatttctcatgacatttattcaaataaaccatacattttttaaatttttkctaggattaaaataatagattttgttaaagcacaaacttttgggggaggtcccaaaaaat

SEQ ID NO: 2304 - DNA, 121 bp, Gadus morhua
cacatcaccacggtacaaaaggcagcaggccatgtatttgccgtggcgtgggtcgcatttyaccatctgattggccggctcaaagcaggcattggtgatttccgaaaccgttaactgctca

SEQ ID NO: 2305 - DNA, 121 bp, Gadus morhua
gtgggaattacatttgagcggttgtctattcatttgtattcaaaactcctataacgtgaawagcacactttttttgatatkcattcaatcgattcatgttcatttacttaaaagatatgaa

SEQ ID NO: 2306 - DNA, 121 bp, Gadus morhua
ttgtgtgacaagccccagctcgctgacgttgacctccacgacrgttccctttgtgatgacycccaggctggtgtacagtggagacgatgggttcttcttcacccccaggatgggcaggcag

SEQ ID NO: 2307 - DNA, 121 bp, Gadus morhua
tgggacacgccccctcctctccacaacggcgatcggatgctgccaacacgagcgcgcccgsgtgccctttctgtcgccaatggtttccctcccaccggccctgacctctgacctcaccttg

SEQ ID NO: 2308 - DNA, 121 bp, Gadus morhua
tttaaaaatttcaaaccgtatacagatgtatatataatacactaactagttgttaatgtgytacaaacaattgtgattccaagtggaatgaaaaaaattatagcagaagaactgtatccta

SEQ ID NO: 2309 - DNA, 121 bp, Gadus morhua
tcagcttgtcagatgggtaccaaaaatgtatttgtagtatctttaaaaatatatatagcawttttgtttttctaaatgaaaaatccaatttacctggcactaataattcacttattgaaag

SEQ ID NO: 2310 - DNA, 121 bp, Gadus morhua
tcaatcactgatcaattcatccacagtgcatcaacctatagatctatatcgatagagatcwatatcgatggatctagaaggagcatctctggatctacatagatctctataatatctagaa

SEQ ID NO: 2311 - DNA, 121 bp, Gadus morhua
taccccccaacgcaaccaatcaggaaaacaataactaattgcctctaacttgtgccttccycatatcccccccccacccaggccttgctctttggaggaagcacttctgtcacggtcacca

SEQ ID NO: 2312 - DNA, 121 bp, Gadus morhua
acatggacagaagagaaagacctccactgtataatttatataataaataaacaagttaacragtcatcagttatttatgcaagctcataatcacaaagtatagtttccaatgggttatcag

SEQ ID NO: 2313 - DNA, 121 bp, Gadus morhua
caaaaatattacctaacgatcgggccccattcccttcctcgaatgcacrccgttaccctckaaggttgctacgagtgaataaacgctggagaagggactattatggcacgtgaagaggata

SEQ ID NO: 2314 - DNA, 121 bp, Gadus morhua
atgactacctctgataatgttaaatgctattaatagcaatttaatcatttcaacagttgakttccgaaaaattmatttgtttggaaggagaggccttccacgggaactgatacaagtataa

SEQ ID NO: 2315 - DNA, 121 bp, Gadus morhua
cttacggacggccttcatgaagtcctcctgggtgacgtactcccggtcggcccggatggcraacagacccgcttccgtgcacacgttcctcagatcggctccgttgaagccatctgacagc

SEQ ID NO: 2316 - DNA, 121 bp, Gadus morhua
ctgcaatgttattttttttttaatcaatattctaaaagaagaaacaattgctaatcccgtkttaaagagctaaaactatcatttagtttgagtatttacttattatttttcatataccaca

SEQ ID NO: 2317 - DNA, 121 bp, Gadus morhua
atttaaagtctgcgggaaaataccaaaccaaaaatcatctcaacgaacatataactctgamtcactctggaatactgsagtattacttccagtacaacttggcagcgttttatttttactt

SEQ ID NO: 2318 - DNA, 121 bp, Gadus morhua
gccgtcatcacggttgggagcagcaaagaagcgctcgaccgcacgccctctcccgcgacastagtgccgttgcccggtttggttgaattggtggagtaggtaagcgcttgttagtagttca

SEQ ID NO: 2319 - DNA, 121 bp, Gadus morhua
tgccatgtttaaagtaaatcgcatttgtgatttacaaatyaccaatgrcaacatttaggcrgttaagaacatggaataatttactgcccccccctgagacggagaacaagatggagggtag

SEQ ID NO: 2320 - DNA, 121 bp, Gadus morhua
gtgcggtggaaaatcacagttttgttttttccaacaacaaaaaaatacatttattggaatmatttttctcttattatctttatttagatgtataggcctatgtattaaagataacgataat

SEQ ID NO: 2321 - DNA, 121 bp, Gadus morhua
atgacaaaaaaatccaaacttctttgtgatcgctcattcaaaatamtagaaaccgaatctwagtgctaagatgaagtgtgtaggatctagtggcctcccgcggtgaggttgcaaccaacta

SEQ ID NO: 2322 - DNA, 121 bp, Gadus morhua
aatttcccatcggcgtggaggaagagatgcaagcctgtccgcaggtccagcagttsaaaysgaaatcggagaccgttgagtttcaagacgattgacccaggaacaccagacggaaagccca

SEQ ID NO: 2323 - DNA, 121 bp, Gadus morhua
ctccagcaggggcagcgcgtccgtcagcagggtcatccagaagctgcgcggggcgatctgkgccgtcatgagggacaggaggagcgtggcggcgtccgagaagcgcttttccccgtactgc

SEQ ID NO: 2324 - DNA, 121 bp, Gadus morhua
agtgctaaaacagtgcttttgggagggctccttggtccccatgccttggtgcctaaraacsggctttaagggtggacaaaccacgracatattctcattgctcgtttaaaacgtctttacc

SEQ ID NO: 2325 - DNA, 121 bp, Gadus morhua
atatttgtgttgtgtcttatcgtttgcatggcctcttcttctctmatccttacttccgacmaatctctttctagcatcgtcctttcgtccaagggcctttcttcgctcttcatgaatatca

SEQ ID NO: 2326 - DNA, 121 bp, Gadus morhua
agggccttgacgatggcctcgttggcgtctatgctgatctgcaccgcggctttggccatcycgtcgatatgcagcggccatctcggactgggccttctccaggttggccttggccactgag

SEQ ID NO: 2327 - DNA, 121 bp, Gadus morhua
aggtcggatcggggtaggttgggtgttgggttgtgcagcgggtgagggagcgggggccggkkgtggttacattgggttgggacgttgggggtttgtctttactcggtacagctgggcctgg

SEQ ID NO: 2328 - DNA, 121 bp, Gadus morhua
gcacatgatcctgtcgtctgagcagccgttctcgactgaaatgctggccagctccgggttkagggtggtcagcggcgtgcggggtagccctgaagccatgacggctcttctacgggctcgt

SEQ ID NO: 2329 - DNA, 121 bp, Gadus morhua
tcgaagagcaggagcatggtccaggttcctggacgagttggtcgtgacgaagccgggccartgtggcggtcttcatgcggaggtttcctcgccaagggatcgtaaacaaattcgggcgact

SEQ ID NO: 2330 - DNA, 121 bp, Gadus morhua
cagctcggagaagcccaggcggtccgcgttggagatgtcaaagggtcccggccacgggcgscggtgtccacgccccctgttccacgcttctggagccgcagcttcttgaggatctcctcaa

SEQ ID NO: 2331 - DNA, 121 bp, Gadus morhua
catttcttccttggggactatcgggtcgaccggcagaccgatctccttgccccgcagcttsagggccgatggccctctcgatcttgcccatgacctggtttgttgggaatcgctttcccgc

SEQ ID NO: 2332 - DNA, 121 bp, Gadus morhua
taaaacaatgttttacctgaaaacctgtgaaatgtgttattcctcaaagtgaaggttgaakgtcatatgtctgccgttcctttcacttgtcggccgactggatacggtatgagtgtgccgt

SEQ ID NO: 2333 - DNA, 121 bp, Gadus morhua
cattcctccacgaccccgacctgtggccgccacgtgagctgtgagaatggccgcctggccyctcccggcccctgatccctggttctggttcttcatgctctttaacatgggtgcgttcttt

SEQ ID NO: 2334 - DNA, 121 bp, Gadus morhua
aaaatcgttatcttgtaagcaactcagtcgtcagacattctgaatacctttattacgtagytattacactactgtgtaataggatgattatactgattatactgaaaagggaaattatttc

SEQ ID NO: 2335 - DNA, 121 bp, Gadus morhua
atgcmagtaaaatttgagtagagagtggacaaggtgcaaaagacraggttttaaatggtcmgaagctgatggagagagatgaattgtgcaggtacgaargaaggggaaaacaagggaatca

SEQ ID NO: 2336 - DNA, 121 bp, Gadus morhua
tggtatttactggagtcacattaaaagctttaagtcaccgaacaacwtkaacaacaacttyaaacaaagtatacccactgatacatgctatttccagtcatatgtaattgtcggaagcata

SEQ ID NO: 2337 - DNA, 121 bp, Gadus morhua
agagttgtacagatgccgttcgaggcgtgagatcttcatggccttcagcgtggccgagtckaccagcacggggggccccagttcaaacacgtctcggatgaactcgttggcctgcaggtgg

SEQ ID NO: 2338 - DNA, 121 bp, Gadus morhua
tcaaagaaaaacataccttgggctaacacttgacatttcaaattttaacagatttattatwataaaagaatatttgttactgcaaaacttttacatcttagcaatataacatgtttgacat

SEQ ID NO: 2339 - DNA, 121 bp, Gadus morhua
ggagtgttactcctttgcttgctgtggagggaaaataaatacgctaaatattatatatacmagaaattagtattcatgaacgacattgtagtagtttccccctgcaacagacttttggggg

SEQ ID NO: 2340 - DNA, 121 bp, Gadus morhua
gtgaaaaaagaaaaaaaaaaaaaagcaggggatgaaacaaaaaaaagtctgatacgtttaktcaaattcracagcaaaacaaaatggctaccgatacgcacagcagtagcggttaactagc

SEQ ID NO: 2341 - DNA, 121 bp, Gadus morhua
ctgggtaacctacgatggagaaaacttggagccgatgctaaatgaccggccaatcagcgtwggttttgaggctggtttatrtgtgacgcaacaagaagcgactcagtctaaacaacatggc

SEQ ID NO: 2342 - DNA, 121 bp, Gadus morhua
aatacttgaataccacagttctaaacaaaatacaatttgtattatgttcactttgttttgkcctttcacgatatcttacaccaaaacatttgtctgtgttggcaaacctcctggtatgtta

SEQ ID NO: 2343 - DNA, 121 bp, Gadus morhua
aaaacttttgtacagtctgacaaaaagtaccatgggatatattaagtggaagcctgtaaartagattgactggcttattataataaattgaagttggattaaaataaaaaaaatggttgat

SEQ ID NO: 2344 - DNA, 121 bp, Gadus morhua
ttttaattgtttggtaaatcatgtaatggcgaaattgtggacagctcaaatggaaaaagaraggacactttattttccayatcactcaacatgtatatagatttttcataccccctatttg

SEQ ID NO: 2345 - DNA, 121 bp, Gadus morhua
taacttttattacctgattgatttgagttataagagtacataaataatacattattctcaragggatgagtgtagcacgaatttcatcccgtaatcaacattatcttgtacatcgaaacaa

SEQ ID NO: 2346 - DNA, 121 bp, Gadus morhua
taaaacgttatctgttgtaatatatttgttgaatctgtacagcatatactcatatttcttytctatctttttacaaaattcaaacaattaccagggaataacatgtagatattttcttaac

SEQ ID NO: 2347 - DNA, 121 bp, Gadus morhua
accaataaacatctttatttttctaagttgttggcaaaaggcygggatacttgtgcttttwacatgtgcagtcatcttagcaaaatactttccatggtctccggagacactgaagcacgca

SEQ ID NO: 2348 - DNA, 121 bp, Gadus morhua
gctctcttaacacatgtgaggggtgagggtagccttccataaaatctcatctaaaawtttkaacaaaataacataacattcagttgattgcagtatcccttcaatttgtatatttccttca

SEQ ID NO: 2349 - DNA, 121 bp, Gadus morhua
ctcccaagagacatttggttaccaagacaggaaaccaaaaggggttggggggccggttggwtgaatgggcggtggtgatgagggcggtggtgatgagggcgacggaggaggttgggaggga

SEQ ID NO: 2350 - DNA, 121 bp, Gadus morhua
ccagaaaagtagcgaccgaggttgacattcacattgctgagcacctcggccccgcccaaaracgacccatccagggggtcccgctgacgaggagagaatcacttcacatgtccacgtagaa

SEQ ID NO: 2351 - DNA, 121 bp, Gadus morhua
tttttttgtacaatataacaatgattgaatacactatcaacgttatgcttacgtaaatgtycatatatatattccccttaaactatatgttagcttttaaggtctgtacaacttggttcac

SEQ ID NO: 2352 - DNA, 121 bp, Gadus morhua
ccggcccatgctcaattgcatcttataacactgctcgcaggcgatwgagagtccgaccackagagacacaaactcctcaaagtccacctgggccatcgccgttggtgtccagacccttcat

SEQ ID NO: 2353 - DNA, 121 bp, Gadus morhua
acaccactgtctaaatcgagcatttttcaccttgtaatcattatttaattaaattaataamaaatcacattagaacaaacctgagaacatatggttctcattaaccaactataacctttaa

SEQ ID NO: 2354 - DNA, 121 bp, Gadus morhua
tctgcagtctcacgatcaattttttattccctgatgatatgagtattacaattgttatttrttattctttcaaaccaattcttaaaatgttcattgttttcctgaaataaatggttttttg

SEQ ID NO: 2355 - DNA, 121 bp, Gadus morhua
aattgtttaaataaacttgaaatttgttaaggataaaaaatataaatagatttaaatttcmacaacattttctgggaaacattcactccttctccagttaaagctattcaagttgcttcaa

SEQ ID NO: 2356 - DNA, 121 bp, Gadus morhua
catcgacactcattctacacccctagcccctgagctagatagtgtgtacaagaatccccckttccattcgamcccctcaccctaaaacacacacgctcgcaaccaggcataattaatatac

SEQ ID NO: 2357 - DNA, 121 bp, Gadus morhua
atgctttttgctacttcaaatcctttcccaatattattaatttccaaaatttaaattaatwgggcaatattttatttatttttaccgtaaattaaagtkgttcattgaatcttattgttat

SEQ ID NO: 2358 - DNA, 121 bp, Gadus morhua
ttcccatgtcgtagtacgcgatcgctcccttcagttgcttttcacggctccaatcggggmratcccgctggacttctttaatgatatcaaccaggatcttagtggcttggttccacgtgtt

SEQ ID NO: 2359 - DNA, 121 bp, Gadus morhua
agggggaacccttacagcgggatccatatctgtggacgacgagtgggcgtggcggtgcggrgggagggggcaacagatggtgggtccacacgcagaacactctagtgtaagtgtgtatgta

SEQ ID NO: 2360 - DNA, 121 bp, Gadus morhua
caaacaggctgcatacgtttcatgaaattgtccgtattatgaackaagcaatcagactttrgtgactctagtccaatctccagtatccagtattggctagtgggggccgatccaggtcact

SEQ ID NO: 2361 - DNA, 121 bp, Gadus morhua
tttattggaatacacaaaccaacaaacggttaaaagacaacccaagggttaaaaaaaaatymctttaaaacccaaccmcaccttataaaaaccaaattaaaaacaaaaacaaatcacctta

SEQ ID NO: 2362 - DNA, 121 bp, Gadus morhua
tgcatgcatgatggggaaacaggtcgccctgtaaaattgtctyctgatgattctggakaarttcattgtacgttgacggtcctgcagttcccttcaaactcttgctgagagttgcacgcac

SEQ ID NO: 2363 - DNA, 121 bp, Gadus morhua
ctttaatgaaaccattaccacccaaccccaaaatgttattgtatgcatgtgttatgtaatrcataaaaccattttgtttttatgtattacataaaaacaaaagcatgtccttgagtttggc

SEQ ID NO: 2364 - DNA, 121 bp, Gadus morhua
acttcccaggatcagtttattccaagcaaaaaaattaattcaatataattacaagtcgagmatcaaaaaagtagtctaattgttgaactgggcatcttgcacgtgaatatatcttctaaac

SEQ ID NO: 2365 - DNA, 121 bp, Gadus morhua
attcacatccctacttataatatactttctggcttgaaaaccacttatttagacattatartctaaatgtcgatagagatgtaattacaattgttgatctatggaacatgcataaaagaac

SEQ ID NO: 2366 - DNA, 121 bp, Gadus morhua
gaaatataggacccgatgtctttagtctttaaaagagccaatactttactctatggatttkttkttttttatatacgagccatttcaatatctatccaccagtgaaatcacaagttgctat

SEQ ID NO: 2367 - DNA, 121 bp, Gadus morhua
ctatttgtagctgtttggagaacaccaagcaacaagcgggaggttagaggtcaggscgatycggtagcacaagatttcagatggacaccgataaaaggaaaggcaaagacgacttcatcaa

SEQ ID NO: 2368 - DNA, 121 bp, Gadus morhua
aatatattctgaccctgtctttgacgtagacgcttgcttgcttggagcccccccccccgamaaattatcaagttattccctcttttggtgcgatattacctgcaatacagcgaaagagccc

SEQ ID NO: 2369 - DNA, 121 bp, Gadus morhua
cttttctgacagtaaaacgtgtagctctggaatattcccctctgcggytgacaattccccrgtcaagatgtagtgtttgtcgctggctccaggcagaaagttcacagtagaacaggttatt

SEQ ID NO: 2370 - DNA, 121 bp, Gadus morhua
caacaaggacagtgtatataaattattatgaagcaagcacaaccattttacaaaaggtttwaatcccttcgataggtyttgtagaatgtaaaaacaaccaatgccaatactggtaattcca

SEQ ID NO: 2371 - DNA, 121 bp, Gadus morhua
tccccgtcctttcttgccatccttttggcttcctgtctgggaggccagggagcccatggcrttgcgaatggcctccgttgttagggtctacacccgggagattctccaggacactctgaag

SEQ ID NO: 2372 - DNA, 121 bp, Gadus morhua
cacctcttctggatccacgagagggtcacctcttctgggtccactaggagggggggggggrrgaatgggaaactwaaccattgaaactaaaagcccgatcttttattaaacaatgattgca

SEQ ID NO: 2373 - DNA, 121 bp, Gadus morhua
cctgaagaggctcaatagatcctcattttaattacttacatagattaccccaatattccaygtcctataatatcactaaatagataacgaccctccatattacactgccaaagagaaagag

SEQ ID NO: 2374 - DNA, 121 bp, Gadus morhua
aatacatagattttaatctgtatcgtaaaacaacctccagcaaagaaagacattttgaatrcgccattggaacgggggaaattcacatgaatggtcacaattatggtacgcctgtatttta

SEQ ID NO: 2375 - DNA, 121 bp, Gadus morhua
gatctatagatcaaatatacagaacatgggtaccaccatctttttttttccataaatgttkgccatggcaggcagaaacacataccagatgcatcacacacacgcacacaaacacacacac

SEQ ID NO: 2376 - DNA, 121 bp, Gadus morhua
tttttctgaagtccaaaatatttctgtcttccttcattaaaatggggacaatcattcaggmcatgctttccaaaacctasaagggaatatctttctctgttaatgttcagcggactgagtc

SEQ ID NO: 2377 - DNA, 121 bp, Gadus morhua
tgaactatactctatagaattgcacataaagttaatacatctgatrattaacgacatagtrgaaatcattgaaaggcgatacaagttttcataatgctgataaccgtgtcgtttgttaata

SEQ ID NO: 2378 - DNA, 121 bp, Gadus morhua
aacagaagcatctgtataagcatgttacaggaacaggatagggaaattaaaaaaaaaattwaarggaaattttaaaaatcaggcactttcacattaagtaaaacgttgaatcttgaatcgg

SEQ ID NO: 2379 - DNA, 121 bp, Gadus morhua
gtcgccgccaccttcctcgaatcccaccgtgcgcgtcaccgggtcgatgttgacggtgcarccgtccacggtcacgcgcaggtgtttgttctcaaactgcacgcagtccccggcaaacatg

SEQ ID NO: 2380 - DNA, 121 bp, Gadus morhua
catctccttcactgcgaacttgcggatctccttgatggcgcgaggggccctcttcttgaarctcacgccatggatgcgcttgtggatgttgatggtgtactctctggtgaccacctcgttg

SEQ ID NO: 2381 - DNA, 121 bp, Gadus morhua
agtgaatttttttaaccaaatgcattcaataccagactttaaattgtgtttatctttagtraggagatagaacattttaattcaactacaggracaacagcaagtgtgaggggagagcaag

SEQ ID NO: 2382 - DNA, 121 bp, Gadus morhua
tcgatctcgtagtgtttcagccaattgttgacctcgtcgtcggtgtttaggggacaggackgaaaactctcttggcattaygtgaatctttgctttttcctttcttggatgataaaaggtg

SEQ ID NO: 2383 - DNA, 121 bp, Gadus morhua
ttcgtcagatgcagcaggtgcagcgggggcatcatctgcagccggcacgacctttctctgwggcctctcctccagcccctccaggaagggggccacatcaccatcgtcgtagatgatgaac

SEQ ID NO: 2384 - DNA, 121 bp, Gadus morhua
tatattgtaaaaagttcccacatccacactcttaataaatatatacacataagtactgatrtacaaaaggttgtgcagatcaagcattactttagaagcagagcttgacaaaggcactgac

SEQ ID NO: 2385 - DNA, 121 bp, Gadus morhua
atctttctcttctccatcgttgtcgcctccgtcgtctgagctctccccaatcccggccgtratggcctccgttgctagttccgtttgtaacctgcctcccgttggcaggagccttcttcgt

SEQ ID NO: 2386 - DNA, 121 bp, Gadus morhua
cataccagtattcatactggtattataccagtaagatgtctacgagaaaccaaagggccgrccaccaggaggtcgagggggcggggccgggggatcatggggcacatctatttttgttatt

SEQ ID NO: 2387 - DNA, 121 bp, Gadus morhua
atgacccatgattgtcacaatatattgtgcgagacttaacaccagtacccatgaataacasgcctcgaaaytttaaccaaggtaacagaaaacattccaatgtgttctgcggaattggaat

SEQ ID NO: 2388 - DNA, 121 bp, Gadus morhua
tatccctgaaattagtctaccagataacttcttaacaatgccatggaaaggatgggatatmatacagccaacaaatacatttaacaagtcatagacatatgaaaacaaatgggggatgaga

SEQ ID NO: 2389 - DNA, 121 bp, Gadus morhua
ttcctttataaaaagtactgactagggaaaagagaacacattactatagtaatacacagcygtttagtccagagtgataatgggctaatcttgaggttttaaaaatatcttcttggtaggt

SEQ ID NO: 2390 - DNA, 121 bp, Gadus morhua
agtgawgtacaataaggtgggcctaaaagtggatgtagaacggrtttacagwaacgaggckgagttcaatctccgcctatttccattgtgtagatgaaaaaattgcgggcaccatctctcc

SEQ ID NO: 2391 - DNA, 121 bp, Gadus morhua
agcttctcggggtgctacccgctcytcgaggctgttctccttgaagaagtgggcaaagccmggcagcgctacgtcgtcacggctgaaatagaaagccatagactggtatgtgtaggaggca

SEQ ID NO: 2392 - DNA, 121 bp, Gadus morhua
ttggctgatccttagaagccagtgccttgtggcggcccagtttggcgtctcagtgcgggcrctgtgggccagcttcttctcgatgttcatggccagcatctgactgcggaaggacaggctc

SEQ ID NO: 2393 - DNA, 121 bp, Gadus morhua
aatgaaaatcaatgctaataaattatggatattactaatgcagttgaccattttgatagayatttttttaaatggcgtcartagatttatttcgcttttcacattttgtcacatttagaat

SEQ ID NO: 2394 - DNA, 121 bp, Gadus morhua
aaaaattattttttacatttaaaaagcctctattgcaagcttagaaatataagtggtttgkggtttgtaaatatagcattctatacttttgacacaacagggtcctgttacctttaattac

SEQ ID NO: 2395 - DNA, 121 bp, Gadus morhua
ccagctccgccatataaaagtggctgcttagaaaacacagagaaagggaaggagcatttgktgagacatcgyamcacatcttttccctccatctccccagttgtatagcgctactttaccc

SEQ ID NO: 2396 - DNA, 121 bp, Gadus morhua
ttgaatataagaaaaaaaacaatatgcataatgacatgcatgactacacttggcagctaamggatacagggcaccwcttaaagtctaagaaattgacagagagcaaagggtaggcatgtat

SEQ ID NO: 2397 - DNA, 121 bp, Gadus morhua
aggcaggttgttgctctgtaggatgtcctcgtattcagactggcccttgtggaactcgtartcctcaacggcgtgatgctgggagatctcaaagacatcccccaagacattcccgggtttc

SEQ ID NO: 2398 - DNA, 121 bp, Gadus morhua
aaacacctaacccaaaccttgggtttcctgaccacaagttggtcaatgggttccgggcgawtcccctggagcgaatcccctggagcaaaaagaaaaaatatgtcagcacataaatcataat

SEQ ID NO: 2399 - DNA, 121 bp, Gadus morhua
acacctggtacattacagccttcatcatcatcatcactttaaacacaaacccaagagacgktatactttatcaatggtatatataggataaatatcttatatatgtatgaatatataagat

SEQ ID NO: 2400 - DNA, 121 bp, Gadus morhua
accgttactttgacctcatctgattcggttatggtctcagaggaggtcattgaggtggtcwgcgccgctcccacggtcacgctaaacccaccagacacctccaccaggtccgggatccctg

SEQ ID NO: 2401 - DNA, 121 bp, Gadus morhua
taaaaactagracagaaaggatgctactgtatgaaaaacaaattaaacagtcaagcaraaygcatgtatattattcacaaaaaaggtgagatcaacacaactgaacactttaaaaaccttc

SEQ ID NO: 2402 - DNA, 121 bp, Gadus morhua
aaaacccagcaccgtaatacaatgatcaacttctggaggagaggtggaaagaaaakaaaakaaatcaaagaatagaggaatccgaaaaacgtaaagtaggggttcggcctcgttcggaaat

SEQ ID NO: 2403 - DNA, 121 bp, Gadus morhua
gcattattttttctggagattggtatatattacatgcaactctgtactttgtagtgtgaaragcccttcygagtcctctttaggtgttttcatatctgcagtagaacctgcatcttaatat

SEQ ID NO: 2404 - DNA, 121 bp, Gadus morhua
aatacttgtcttgataaaagagtgtgtcctattcaatgctgaaaaaaagtatatcaatcawtwcaaatgagttattagtatggtgtggaagtgtgtgtggatgatggccagttaaagcagc

SEQ ID NO: 2405 - DNA, 121 bp, Gadus morhua
attcaaggaaaatctacaatgaacaagtgcatttggatttatcataattgtatgactgatscgctatattagtttcacttaaagtttcattattttctcgaaacagtattagttttcataa

SEQ ID NO: 2406 - DNA, 121 bp, Gadus morhua
tgaaacagcaccgttaaagcagaaggactaaacaagccccggaattgggaaccaccggtcktggccaggtttttaggggcagccgctccgggagaatgatcttcaatgagctcctttggtg

SEQ ID NO: 2407 - DNA, 121 bp, Gadus morhua
gggcgcaccaaaacacctgaaacacaagtattggcaccgttggccggttgcctggtaaccrgatcaccacggtacgctggttgcccggttaccagattaccacggtatgcaagtaagctgg

SEQ ID NO: 2408 - DNA, 121 bp, Gadus morhua
ccaatcttaaatactgatagacaacatattaaagatatatctttttttgttttgttttaargaaacataaaaacaagagaaggtttctagaactgtcctccacctgggcaaaaggcaggaa

SEQ ID NO: 2409 - DNA, 121 bp, Gadus morhua
agtactgcaggaaaaggaggtgcaggttttctccagatcagaagcagtctcaggggcactkccggagggacatgacggcgttcacgtagccagtttccaggaaagcatcggctgtagtttg

SEQ ID NO: 2410 - DNA, 121 bp, Gadus morhua
tttggtattggatcataagtgcggcctcaaaaacctttgattttttttttttttggttttwagtcwttttttttaatcacattgtatctttccgtctcgaaatggcgcagttatggattga

SEQ ID NO: 2411 - DNA, 121 bp, Gadus morhua
agggcggaaaaccaccgcgcacaggtacttctgccacgcagcctgcatctccgggactcawatgctatccccagcgatcccgggcgacgacttttggtcaggcacatcacacagacagtcg

SEQ ID NO: 2412 - DNA, 121 bp, Gadus morhua
tacattgcctgacacattaaagaaaggatttatacaattgtgatacataytgtggggattsacataaatgctgagtggttggaagcctatcaacaacatagtaatgttgtcttcaagctta

SEQ ID NO: 2413 - DNA, 121 bp, Gadus morhua
caggaaaggagagcttgagcaccatcaaccactgttccatactcagaggggtcatcttgargatcatgggcagggggtcgacgtagatgatcatgaagtggagggacatggacagggacat

SEQ ID NO: 2414 - DNA, 121 bp, Gadus morhua
ggccgcctggatctcggctctctgattggtctgtcttccccccagacgatctgcagcgttyagtggatggttgggtccccagtaaactccgatccctgcccgcgcccccttccgtccgtta

SEQ ID NO: 2415 - DNA, 121 bp, Gadus morhua
cttatcctgcgggccagctggatgtccttggggcatgatagtgacccgcttggcgtggatkgcgcacaggttggtgtcctcaagacagaccaaccaggtaggcttcgactggcctcctgaa

SEQ ID NO: 2416 - DNA, 121 bp, Gadus morhua
ggcctgcaggggttcaagctgctcttgaggtggggactggtgctcctttgacgtggctccrtggccaggaggcaacgcgttttcatatccatgtacctctggaatagcatttccttcaatg

SEQ ID NO: 2417 - DNA, 121 bp, Gadus morhua
tatgatgggctatcttaacgcatacatgtttttttttaacacatacaccatgtgtatgtgwgttatttaaccatttggattttgttcaaaaaaatattctgccatgaagcaacttatacat

SEQ ID NO: 2418 - DNA, 121 bp, Gadus morhua
ccgcttgcaccgtctgctggcttgttccccggtattaaattcttcacccaaatggaaaacyggwgctytggacacataaagaccacagcgattagcactgcaaatacaacaacaagcagga

SEQ ID NO: 2419 - DNA, 121 bp, Gadus morhua
tcattgttgtttttttggaagggggagcatttcaacgtaggaatttctaattcctacgtaraaatgttttcaaaaaggaagtaaccactggcaattattaaggccacaaaacaatgtttca

SEQ ID NO: 2420 - DNA, 121 bp, Gadus morhua
tttcatacagaattatcaagcctttctgggctctaccaaatcaaccccagcgccgttaccwccacagtcccaactaccacctctgatcgtagaaaactaacgtgatcacaaaggtcttttt

SEQ ID NO: 2421 - DNA, 121 bp, Gadus morhua
ccccatccaccagacacttctgcctcaacagagtctccctcgcgtgcggtgtatctccttyccggcctcaggccccgtaaacgctctcgttactgtaggtcatgtagaggaacagatcctc

SEQ ID NO: 2422 - DNA, 121 bp, Gadus morhua
caaaccacattataatcaacactatttataagaccaagtcatagaatatatgctgtggcawaaatttataaaatgatcacttatttaatttatctaatgaaactgcctagtgtatgctatg

SEQ ID NO: 2423 - DNA, 121 bp, Gadus morhua
attctgaaatcgttgagcttgacatcggcagagttgacttcccttccaagaagccctgtgrgggggggggggggsgcgctaaacgggtaaggtagaaagagattagaaaaagctagctatt

SEQ ID NO: 2424 - DNA, 121 bp, Gadus morhua
gtacttcacatccacaacgacctctgtgtctggagaggtcaccttcatggccgacatcaayctgttggtggtctggtcggacagcctgcgagcctctacaggatccttcttgaggagcgtt

SEQ ID NO: 2425 - DNA, 121 bp, Gadus morhua
cagccagctcccataccagcctacagtgcagagaaagaaggatccacttcacccagcaatycagcatttggcagcggttctttttagcagacccagactaggaaacctttggaggttcttg

SEQ ID NO: 2426 - DNA, 121 bp, Gadus morhua
gagaacagaaaaggyttgatttcattttgggacaggaacccctggttccctctccccatrycaagaagttctgggattttgacccctgcggctcccagcgttaagagggtccccttgctgg

SEQ ID NO: 2427 - DNA, 121 bp, Gadus morhua
ccatttacctcttacgggctcagattaagggcttcatcgcccataagcacgggatgcgggyggtggagggaaacccgcttgaagtatttcttcatggagaacacctgacggcctcggatgt

SEQ ID NO: 2428 - DNA, 121 bp, Gadus morhua
gtttgataaatacagctaattagattatgttagatcatttttgcatcgattattactaacsggaatttaaccagacaatatgtaataatccctacatagggataccattttctaaataacc

SEQ ID NO: 2429 - DNA, 121 bp, Gadus morhua
cgtggagctagtgcaaatgcagtgtcttcaattggctgccagtcctgtggcctcggaggaragcctggcgttgatgaggtactcggccaggctgatgctggcgggaaagcccgtgatggtc

SEQ ID NO: 2430 - DNA, 121 bp, Gadus morhua
atttatgaatatgccatttagctaataaaataataaggtttataataaattttctgttttkgtttgaccagaggtgtaattgaagaaaccaaacaatacatgctcaacacaacaaacaata

SEQ ID NO: 2431 - DNA, 121 bp, Gadus morhua
tcgccgtgtgggaggtcaccacattttttcccgatagtgcatctcaaccctggcaatgaaygcaatgggccaacgcccgtgtttgaacttagatgacatgacacgccgatgaaacgactca

SEQ ID NO: 2432 - DNA, 121 bp, Gadus morhua
ataattaaacatcttcgcagactcgaggaagtagtcggaggagtcgtgcagcagcatgacsagcgtcccggcgcggatgtagttcataccaccaggagaagcacagcagtacgatggtggc

SEQ ID NO: 2433 - DNA, 121 bp, Gadus morhua
aaagggtcttcaacacagtaacagtcggttggagtttaatactaratgcgcattcgtgcaraatgtcttgtctgcagcccagcgtttcataggctctaaaaaacgaccacgctaacagggc

SEQ ID NO: 2434 - DNA, 121 bp, Gadus morhua
gatcttacattatttaaatgtcacaaatacaaagtcagtgtggtggggatacggtccaggkttctgcagcaccggttcatcgtcatgaccaatgtgatgcagaaaatactgagcattccca

SEQ ID NO: 2435 - DNA, 121 bp, Gadus morhua
aacctgctctgtctgatcatgccctgcttaccaatgacctcaaacaacaasaaaggaaaartaggctgtttcctgtaggcttttctgcaaggtttgtcccccacccagtgcttgtgtgttc

SEQ ID NO: 2436 - DNA, 121 bp, Gadus morhua
aagtcaagacaatgttgaaacaacagaagaaatgacagcaacctacaggccgaaggcagayactctcaagagaggatggtgagaagcagcaaagtcccgggtgaggccaggggtctacagg

SEQ ID NO: 2437 - DNA, 121 bp, Gadus morhua
acagtaagcgttgcatacacgccattgcccaaagattatctcttaaggggaatttaacatyactaaggagtttaaagacacgtagtaaacaaacacgaaagaaatatggaatatgaacatc

SEQ ID NO: 2438 - DNA, 121 bp, Gadus morhua
ttttgtgaccacacagggagggaagcggggtagtcatagtaacagtaygagaggtaccggkaatggggaggggctgtttgaaagtaaagttgtgcggcggaggccaatgttggagcagaaa

SEQ ID NO: 2439 - DNA, 121 bp, Gadus morhua
acaaattaaaaaatggcctttcctaaattaacaattaaaaagttggtgcaaaattagcaaratattaattttttgtataaacaattacaaagtaaccaggcctatttgaagatamccctcc

SEQ ID NO: 2440 - DNA, 121 bp, Gadus morhua
ttgcaactttttacagtttaaattccggacttgtggaagaacagctctaagcctaaactcrtggatggratgaaacctagcgggtactatcaaacgcagccgaataacggctagaatttaa

SEQ ID NO: 2441 - DNA, 121 bp, Gadus morhua
gctgaggtctgacgatgtcgtactatgcatacagtacacaaccagggcactgcccggagtytactgagcagagcatgctccattgctcacccctccacacatcaacaaggcagggcagcga

SEQ ID NO: 2442 - DNA, 121 bp, Gadus morhua
acgttttgtgtttacaccttgtttaatgatttcatttttcatcaatatctgtgccattcakttttcatttkttgaagaagaaatacattacaaaccaacgcttttgctttmgagttttata

SEQ ID NO: 2443 - DNA, 121 bp, Gadus morhua
tacttaaaaagtgataatacagcattcaaagcatgtggtggtgatttgaagcatgggtgtwctagtgttcacttagtataggcagcgttatgtgcttgctgaaggaaaatgatcgttcttt

SEQ ID NO: 2444 - DNA, 121 bp, Gadus morhua
cgggtgacgcagtcagacactagtgcgacagacggccatttcagtagccatcaggtygttwctttgcaatcaattatttgccatttkacgaagctaccgagagtcttccaaggaacttgat

SEQ ID NO: 2445 - DNA, 121 bp, Gadus morhua
taaaaccataataataatgttcagaaatgttctatgtattcgtagttgaaatttacgattygtaaaagtaggcctattcaattaacaacttgtagacaaaggacaggaaacacgagaggra

SEQ ID NO: 2446 - DNA, 121 bp, Gadus morhua
aaatacatactaaagtttaaagttaagagaaacagacgtaaaaaccgtaaggaaaaacaamtatatttacacatcattttatatacacaataagtgtgtggacacgccaagaaggtcctta

SEQ ID NO: 2447 - DNA, 121 bp, Gadus morhua
atttcttactttgacacaacctaatagagtgattttttgtccattataaacaccgtcattmctkgaataccagtgggacaaattgcagcattttagttcttcaggtcaaaacagcagtcaa

SEQ ID NO: 2448 - DNA, 121 bp, Gadus morhua
cttgcgaccggccatgtagtgagggtggttgaagtcggagacccatgccttggcaccgtgkcccatgctgaccgtcatcttgttgggactccccagctcagagaacttcttctgcatgtaa

SEQ ID NO: 2449 - DNA, 121 bp, Gadus morhua
aacattagttaaactgacgaggcctagtctctgctgggaaggatttttgtgcagtaagtcsatattatgcratgaagtcttgcttctccaaatttacaacctgtattaaataaaatacaat

SEQ ID NO: 2450 - DNA, 121 bp, Gadus morhua
ttatcgattaaaagacagaattgtaattgaataaacattggctttcttgaatgcatgtcaycttggcaawttcctcttttttaaagtgtatatgttgaaattaaatctcattttttgtcat

SEQ ID NO: 2451 - DNA, 121 bp, Gadus morhua
ttcaataaaaattccatttttaatttaatttaattttccatttaattaacattaaatgtawcaatttgaacacgaaaacaccagacatgccgcttacaatttggtaaataacatgcttttt

SEQ ID NO: 2452 - DNA, 121 bp, Gadus morhua
tattgtattataccaaaaagcagctacaatcaatagtactggtaaaacagtaattaataawagtagcatgcagagtgcagactcaaatgaattacccttaaataaggatgcaatgcaattg

SEQ ID NO: 2453 - DNA, 121 bp, Gadus morhua
cttgtggctcaccaactgcacattaccatcttcatagtagtgcacctggattttcagcackcccaccacatgggccgtggactgaccgagggtgagcttccattctgacctacagcgcccg

SEQ ID NO: 2454 - DNA, 121 bp, Gadus morhua
aagtctgtgattcaagcaaaagtatatgcacaaaaaagtacaccacctatttataaatctwaaacattaatatacattctgtccacaaggggttcaatatacgtcagcaaactttcaatcc

SEQ ID NO: 2455 - DNA, 121 bp, Gadus morhua
agagagccaggacyaccaggactaccaggttctcattccaaagctctctgcccagtgcatkgacaaaaggggacgcctctttatcatttaaacaatggggtttcttccacaccatgaaaag

SEQ ID NO: 2456 - DNA, 121 bp, Gadus morhua
gagcaacgtgacgtgtgcaaaggaatgtcttccgatagtaaccatagtgagacgggatggyaccgcagtatcctgcgaggccaacccatgacgttttaagttcaagctctcatacaaataa

SEQ ID NO: 2457 - DNA, 121 bp, Gadus morhua
ttaaacattagttatataagctgtaaggcacttggatactctttgatttaagataaagggmaaataatgattataattttaaaaccctgtagtacatttctcccattctatttaagtttgt

SEQ ID NO: 2458 - DNA, 121 bp, Gadus morhua
tatcacgacaaaactagtcatcagaatatcaacaccaatgcaagcgcgcttcatgagacamaaaaagaggatattcttactatttaatacacaaacgcaatatcttatataaaaatacaat

SEQ ID NO: 2459 - DNA, 121 bp, Gadus morhua
tgtcgctgggagtgctggaaactgtagttttaaggtttgggaattacgccygtgtctcaawtgtgttaacacttctcgccttgccttttgattaaagtgtaaacaccaaggcgtttcagat

SEQ ID NO: 2460 - DNA, 121 bp, Gadus morhua
aaaacccatttacaacttgcagatggggtacggctgacaatcccaaaacaagctgcattamgggcgcgttttgcgtcccgcatttaaggggtctcaatctagtaactctcggtggtctcat

SEQ ID NO: 2461 - DNA, 121 bp, Gadus morhua
tgagcgggaagtatattaaccttcaccaacattacaaatttaaaacgggggggggggggawtctgaagccaaacaaaaacaacaacagttagaatggtaaatggggtcacttaatcatcgt

SEQ ID NO: 2462 - DNA, 121 bp, Gadus morhua
agttgtgcctgagaagatcaccatttttttccttttccttttttttgtcttaatggttttwatttctttattttatacaaaaaaactcttaacttctacacatttattgtaacccgatttt

SEQ ID NO: 2463 - DNA, 121 bp, Gadus morhua
agtgctggatccagtgctggaaccagagctggaacctgtgactagggtctggtgttccatmttgcacgggcaggatcgtgacaactttttctcgctggtgccctccttttgaggataatca

SEQ ID NO: 2464 - DNA, 121 bp, Gadus morhua
ggcgctccacgatggggcactcgggtcttgcggaaacgcttggcgggaatagggaccaccrgagtggggcaggtacttggcgtacttctccttcacggcaatgtaggtcctgcagagagat

SEQ ID NO: 2465 - DNA, 121 bp, Gadus morhua
ccttgaagcgctggtagagtttgcgtgtgtagttgacgagagctcttggtcaactgccgcrtgatcttgtacttcccgactcaccgtctcgttgactttacgcaccgccgtgttgagctgc

SEQ ID NO: 2466 - DNA, 121 bp, Gadus morhua
agagtacttggccgagtagccgtgctccttgtgcttcttgcactggcagcagagcagagcrccgccgatcagaaggagcccggcagagccccagccgatgaagagggacgcgcccagctcc

SEQ ID NO: 2467 - DNA, 121 bp, Gadus morhua
ggagagaaaggtaactaaaacaaaaccaactgaaatttaaaatcaccagaaatcctgaarraataacttaacattacacagcagaacatcattctaaccaattcaatgtctacagtttgtc

SEQ ID NO: 2468 - DNA, 121 bp, Gadus morhua
ttaatgcttttgttttacagttataaaatgctttgatagcagtgacctgccattttgccamccaacaacatgcacaggtatggtggaattgtacatacgactgttttattgtattgtggcc

SEQ ID NO: 2469 - DNA, 121 bp, Gadus morhua
gtcatgcctcccccctcgctggatctctckcggcgtgctctcgtcctgcatggccggcgawgctctctcgcacctcttctctcatcgttcgctctccttatgctctctaggctgttagtgg

SEQ ID NO: 2470 - DNA, 121 bp, Gadus morhua
agaagtacatgtaaaataaagtaaatataacaaaaaatctattacatctaagcaatatgtmaatttaatgtttccctaaacacaaacaattgtgtaaacaaaattcatctatcacaagtct

SEQ ID NO: 2471 - DNA, 121 bp, Gadus morhua
gtgtttgggatggatctaaagcgtacgattctaggaacacccttgttgggaggcggggacwaaggatatcgtttcgtgattctcaacgactacactgaggtgtcatcactgccgatatcgg

SEQ ID NO: 2472 - DNA, 121 bp, Gadus morhua
tattgtgaaattattcaagcattgactctgtaaatattggtaaccccgaaattccggcccratycaatttggtatccaattgtcaaaaaaaaaattacaaactattgttgacatttttttg

SEQ ID NO: 2473 - DNA, 121 bp, Gadus morhua
acggtagtcagccagggcaagcccttataggcatcttctgccaggcatagagcagtgcagyttcaccgggggaaggctgagctctttggcaatatccgtgtactttatcatcgacggcatc

SEQ ID NO: 2474 - DNA, 121 bp, Gadus morhua
tgaggttttctggcgtagggtgtctgtgtgttgaataaatgaataaacaactttacatgtycaatttatttggaacaatatattggaagctggatatgggaaaggggtaggggtgtagtcg

SEQ ID NO: 2475 - DNA, 121 bp, Gadus morhua
attttcttatagtatagaatccagaatcccgaagcccctctaaagcgtcacaggaccacgrgtcatatgaccmtatagtggaacactgggtagctaatgctcacataatgaggttaaacca

SEQ ID NO: 2476 - DNA, 121 bp, Gadus morhua
cttgctggctctcttgggtcccaggcggcgagggacggtgctgtcggtcaggccgggaatytccttctcgcccttcttgatgatgaccaagttgaggacgctgaggttggcatccaacaat

SEQ ID NO: 2477 - DNA, 121 bp, Gadus morhua
aataataattcataacaacaataataatattctttaccaaggacttcaaacamaaaaaacraacaaacaaaaaacctttccccttggacaaacaatatttttttcttcttcaattaaggaa

SEQ ID NO: 2478 - DNA, 121 bp, Gadus morhua
ttcaatttattgcagaagatttatatcacttgttaccattctcattctgatcataaatctraagcatcggtagcagtaacgatgcatggtgtctataaaaatcaagttcaagttatctgaa

SEQ ID NO: 2479 - DNA, 121 bp, Gadus morhua
caccctgcggccattgagaccctccagctggggtcgcgccttgaagcgctccaggaagtcyctctccacgtgctccttgactgaaagctgaacgccttccggttggttctggagaacaacg

SEQ ID NO: 2480 - DNA, 121 bp, Gadus morhua
ttgtcgggcttatgttgtgaggggggggattagttacatctacaaaaacgaaataatgatwaaaaaaaagtattttaatgcaacttcaatagttttgaccattaatccaaatctaaaacca

SEQ ID NO: 2481 - DNA, 121 bp, Gadus morhua
gtctttttctgaataatttcttctgagctgcttgccaggtcctactttaacaggttaaagwtgtcatattttagttctccataacaggcaaaaaaargcgttctgattgamcaataggaag

SEQ ID NO: 2482 - DNA, 121 bp, Gadus morhua
ccaaaattcatcacctcttttttgaggtcctctcctcctcgagtcctaaccgcctctcagycgtccgttaaggtagatggtgctgccctctttcacattataggactccaggtgtacgact

SEQ ID NO: 2483 - DNA, 121 bp, Gadus morhua
aactgtacagtgggctggcgacctctagtggaaacaaccttaagcatgcttactgtttgcrgcagggttgaccattgaccacttcgctgaaatccattcccaatccacgcccgtgtgaacg

SEQ ID NO: 2484 - DNA, 121 bp, Gadus morhua
gatgagtctgtgaaatgtgtctattagaatctttttttttttgaggttgccaggtttgcamggtgtccccctcttttgcaatcctttttagaagcttccacccactgcttagtaaggcttt

SEQ ID NO: 2485 - DNA, 121 bp, Gadus morhua
taatttaacaatagcaaaataatattttaaaaaaagttatgggattccaaccaaaaaaaamaactatttaaatttaatttaaaccaaacggattaacttgttgtgaaccttcacgtcgtgg

SEQ ID NO: 2486 - DNA, 121 bp, Gadus morhua
actgcattcaatatacacatactaaataggacaatagccaccggcctcgcttgaccttgcmaacagcttttaggacccccccagaaatgactgatatcggctgcgagcagtattgacaggg

SEQ ID NO: 2487 - DNA, 121 bp, Gadus morhua
ggtattcatcttggagtcgaccctatttgtgacctttttaaaaaaagtaatacatcttgcrtttacaaaaaaaagctttcctcctatttgaacagcaatggaaagggggttaaggcgaaaa

SEQ ID NO: 2488 - DNA, 121 bp, Gadus morhua
aaactatgttcgtatgtagtccgtacggtgaagctaactatatcaatgcccrtaaaacacrtgggaaaaacttgcccgatttaaagcttaggaaaacagaaaaaaacaagcacagacatta

SEQ ID NO: 2489 - DNA, 121 bp, Gadus morhua
tatgttttgtgtgtgttaagtaccttggacacaaatatggtttcagcccgttaacattggrcacaatagtgtttaaagcacacgatataagtgtcagttctccagaatgatcataaccatt

SEQ ID NO: 2490 - DNA, 121 bp, Gadus morhua
cattcacatgtgtgccggcaatagactgcggggagtaatcaatatacaaataaataaaaamcgcgaaataagctgaaaacaaagacacagcaagatgtcacctctttgaaagaaggattaa

SEQ ID NO: 2491 - DNA, 121 bp, Gadus morhua
ctcatgaagacaactgctgcatrtcctcatgacatgtctgtcccctggaagaatctttggrggrctttctgttggccaagattcagtaattaaaaatagataatttttttgccccatcttt

SEQ ID NO: 2492 - DNA, 121 bp, Gadus morhua
ttggtttataaaaaagtagtaccatccaattatgatgacgtgcatgggttgctttgttttyctgccacccccaagcaaaaggaaaaaactggctgcacacagacattcactgattgtctga

SEQ ID NO: 2493 - DNA, 121 bp, Gadus morhua
ctcaaataacataacaaaagagaaacttgtgaattgaagcaaacaataataaaatagccaygcttattttggagtagcataatactaatgagggcatacctcaactaacagcattgctgta

SEQ ID NO: 2494 - DNA, 121 bp, Gadus morhua
agtagagtcataagacacacatgcatatgtacttaaataatattattttccataaaaactsacggatgggctttaggcatcaaacactgcctgtgttagtaggccacgcaaataaaaaagg

SEQ ID NO: 2495 - DNA, 121 bp, Gadus morhua
gtaacctagaatgttttgtaacccattaccaaacattcttgattgaatctaaatgaaaacytttttactttcttagttgaatgctgttaggaaatatattttgaataaaccattgaaatga

SEQ ID NO: 2496 - DNA, 121 bp, Gadus morhua
tcgatgtgggagtacggcaggggcttgtccggagtccacaccgaactggtccatccctgakgccatgatgaggaaggcagccggtgccctggtgtcctctcggagtggctgaggaaggcag

SEQ ID NO: 2497 - DNA, 121 bp, Gadus morhua
tcaattcaacaacagaagcgtaaacaataaaatgggatagccatgcacattactcctttaragtcctttagttttaaaggactgttgacattctggcctgccagaaaaagattgtatgcta

SEQ ID NO: 2498 - DNA, 121 bp, Gadus morhua
cctttggaaaaaaaactgaagcggtcgtctccgcgaaaacggcgttgtgacttacggtaamcaggggggaccttgcgctgcctctaggatctggccgggaacatcttcctgtaacgcccgt

SEQ ID NO: 2499 - DNA, 121 bp, Gadus morhua
attcataaggtgacatttttattaacccattcagggaacatgaaggggggggggcgggtaractttatgttagaacaggtccgaacaattttaaaagggcttaagggacttttggacaact

SEQ ID NO: 2500 - DNA, 121 bp, Gadus morhua
acttattacctagcacaaaagcagcatgatgcatgctatttacaacacaagatgaactatraaatccaatttaaaataagtttggctaaccatggcgataatctcatcggacagccaatga

SEQ ID NO: 2501 - DNA, 121 bp, Gadus morhua
ccaatgtttaacgcccaaatccaaatatttacaccaattaaacttgggaccttatattccmaaaaaaaaaccttaagttaataaaaattgtccatccaccattaacgggggacgggtgtca

SEQ ID NO: 2502 - DNA, 121 bp, Gadus morhua
gagcgtaaacattagtttgtttgaggacgcgtaacgattttaaggctgccaaaaaccaacmtcaatcacagggcatcacataaatgacacccaccctgtaggtttcacatttagttggcat

SEQ ID NO: 2503 - DNA, 121 bp, Gadus morhua
gtgggagaaagaagggtataggcatacagagtagaagtgtacccggttttagaaagaaggktataggcatacagagtagaagtgtaccttgttttttttgctttgcctcagcgaacagagc

SEQ ID NO: 2504 - DNA, 121 bp, Gadus morhua
ttctcaatttcaatgactaattaaaagtaatcacttgacattaaatttaacaccatattykggtgaataaaataaagcagttttcatctcaaactcattttgaaatcaagattccacaggc

SEQ ID NO: 2505 - DNA, 121 bp, Gadus morhua
gggagaaatcctctacattttctatagaatttggttgacttctacaaccatttgaaagatkaatgtaaaaaaaaaaaaaaaatatgtaaaccaaaaaggggtgaaaggaaaaggaaagatg

SEQ ID NO: 2506 - DNA, 121 bp, Gadus morhua
cttccctcatgaaatgtcttaattttccatacaacactcaatcaaatctttaaaaggaccwtttcagttgactaatactattcaaaatgcagcattggtcttatctttttcatcctactca

SEQ ID NO: 2507 - DNA, 121 bp, Gadus morhua
tcatgagctttaaatacctttttaatggttttggtcaaaaaagccataaaccataaaaaaragaaataagggcagttgggtccatcatgcctttttgtcacttgctaaatttgcacaaatt

SEQ ID NO: 2508 - DNA, 121 bp, Gadus morhua
tcctgggttaatgacctttatttattcaacttaactttggtttgggactcatcttaactaraacattgggaaaacgggtactgkgttgttgaaggattccaaaagagaacagaatcaaaac

SEQ ID NO: 2509 - DNA, 121 bp, Gadus morhua
caaaacattgaaaaaggaacaaaatttgaaccccaaacattttgcaaaattaaaaaaaarkttaaaaccagcaatctgtcaaatatcaggtcaggtataaggccaccaaaattacaccaat

SEQ ID NO: 2510 - DNA, 121 bp, Gadus morhua
ttaagtctgtgtgtgtgcactagtgagagagaactgggagtccgtttcctatcatcggtckgctttcggtctttaatttaccaggttccgcttcgctttccctggttgaaaccggatgatt

SEQ ID NO: 2511 - DNA, 121 bp, Gadus morhua
ttgaacatttaaaagacttgcatttacattggagtgaaagcaatatacacattttcctgtrgaagaattcaataaattctgaaataatctaggaattctatgtaaaataagtgattaaaat

SEQ ID NO: 2512 - DNA, 121 bp, Gadus morhua
cccaatcatttccaaaggaacacatagcatgaagagatgttattacgattgatgtgaatamgctgtaaaacctggactacaggrcaatgtaaacagaagaagtgggaactaaatgggatgt

SEQ ID NO: 2513 - DNA, 121 bp, Gadus morhua
tggatacagcatatctttaaacggcaagaaattagcaaccaaaattgttaacaaacaatartattagacttgatataaatctgtagccctgggaaaaaaagcaaatttgttaataaatctt

SEQ ID NO: 2514 - DNA, 121 bp, Gadus morhua
ctcgacccgggcgtagtgccagaaggtggccagcttgggcttggagaaggtcacggcggcrccgatatatgtcggcactttrgccacgattttctgcactgcctgtgccatgttgcgytat

SEQ ID NO: 2515 - DNA, 121 bp, Gadus morhua
ggagcagccgtttacattaggcgacatccagtgaacagttcatgaacaggccagagatcamaagcaggtcggcctggccgggtgatgttaccgagaagatgacatcctagcaataaatact

SEQ ID NO: 2516 - DNA, 121 bp, Gadus morhua
gtcacacaacacaatttgctgtttacttcttactgcatttatctgaatataaaaaaacagyactgtattattttggctaaaaggctttttttatacaagtgacagtttgttatggccgcgc

SEQ ID NO: 2517 - DNA, 121 bp, Gadus morhua
gaaacacaaacagaaaaatatgtattgatcttttgacaaatgcaaagtaaagataaaatcyttgttaaaaaaacattccataaaaatttgacctttactgctgaggttagggcgacactca

SEQ ID NO: 2518 - DNA, 121 bp, Gadus morhua
tgacgttcaagtatggcagccatttaatcaatccatcgcctattatgttaacttttccctraatagatttttaaatgaaaatttgataaccagcttcttaatacaatttgagtttattgaa

SEQ ID NO: 2519 - DNA, 121 bp, Gadus morhua
taaacacaacgtttatgctggacctccgaamgaaaaacgccacccagccatcttctccagktgggaccttccttgtacccatgaaggacaaccacggaggaggagacttgatggagaaaaa

SEQ ID NO: 2520 - DNA, 121 bp, Gadus morhua
ttcctttacttccttcctcattcgcctcaataacaaaaagccaatactttcatactttctyccttatttgtttcactttctatgttgaaacattcgagtgaaggatatccaaaataaagac

SEQ ID NO: 2521 - DNA, 121 bp, Gadus morhua
ggctgaaataaaagtgattctgatctgatggtgacgagggaacccagggggtatccacacsrcgagggttcatagtggtggagtcgtctggagaaggaggcatgagaagacaccgtaggag

SEQ ID NO: 2522 - DNA, 121 bp, Gadus morhua
aatacctttgtcacaaatgcgttttctgaaaaccacttaaatcgaatgatttacacattakctatgctcaaatataaattgttcacaactaatgcacaaacacagcctaaaaaataaaaat

SEQ ID NO: 2523 - DNA, 121 bp, Gadus morhua
ttcaaagacacatgtttcacgtagtgcctacatataaaaaaagagatgctatagtatcgawgctgaaaagaacacataagggacaccataaaaactgtatacactaccatttagccgtgct

SEQ ID NO: 2524 - DNA, 121 bp, Gadus morhua
ctgcttccggctggtcttctcgaagaaccagagcccatcctggtctataagacggaagacyccggcggcttcggtgtgatcctttccagacacaagctctatgggctcccggatttgaaag

SEQ ID NO: 2525 - DNA, 121 bp, Gadus morhua
ggattatgtgttatgagtttaacaggatgttatgttttgaaagcactgcaagacaccaaamaaccaggggggagtccagccaatctttattgttattccacttataagaaaacccttgatt

SEQ ID NO: 2526 - DNA, 121 bp, Gadus morhua
cttctattcaagggtgttattgggaggaacaaccgctgagcaccctgttgagtgttggacyttgyattgtaccaaaattaaaaaccagaaaagtcacacggtgtgttagtaaatgtgaagt

SEQ ID NO: 2527 - DNA, 121 bp, Gadus morhua
cctcctcgatggctcccaccatgtagaacgcctgctcggggagagcgtcgtactcgccatygaggatggactggaagcctttgatcgtctccttcaggggcaccagcttgcccgcgtggcc

SEQ ID NO: 2528 - DNA, 121 bp, Gadus morhua
acaccctttaagttgaaggtcaagggtcgaggttgggtctcatcgccctccccacactggktttttttttttggcaccaagcatgtcaacttctagaagcgagagagcgaacatgacaatg

SEQ ID NO: 2529 - DNA, 121 bp, Gadus morhua
cagaaaattaaaaactcaacaaaccttaattgattgctttagaaagaatacattcaagtamctactttatcattggctttgttgtacaaacatggtcaaaagtgaaaatgaagcgctgcaa

SEQ ID NO: 2530 - DNA, 121 bp, Gadus morhua
gttgggccgagcagagccaactaggagagacctccggtctgcattagcaggcagtacaggrgcgctggcctcttggggtttcactggaaatgtcatggattcctcagagcattagttataa

SEQ ID NO: 2531 - DNA, 121 bp, Gadus morhua
ataaataaaaagggcatggacatatggtaaatgccatgataccttttatttttatattttycattttccaattcttcctaaaatcctaaagtatgattacccttaaccttatatccttgtg

SEQ ID NO: 2532 - DNA, 121 bp, Gadus morhua
caggtaattgcttccgaaatcaattacgctaccatttattcaactatgcaaatattcagcsaatcagagttcttatccgaacgggcgcgtcccccgcccatcagcgtgacgggaagaacgt

SEQ ID NO: 2533 - DNA, 121 bp, Gadus morhua
taatgttacgtgatgagtgggagggcttttacaagccaccgttttctttatgggttccctmagagaaaatctcttaattaatgtctgccctttgttgctatagggatgtagtgtccatggc

SEQ ID NO: 2534 - DNA, 121 bp, Gadus morhua
gtgctacgtccaggttggcgattttgactgagcactgcggttgtagatgggcaaaaggcayggacgccaggctcttcaggttggataagctttcaccacggctccttgcgtacgcatttca

SEQ ID NO: 2535 - DNA, 121 bp, Gadus morhua
acagagagagcaatactgatccacaagcttacgagcccaaaaaggcctagttggctggttyatgcacggtgtacctcgttcaatagcaagagggagatccacatctcacagagctttctat

SEQ ID NO: 2536 - DNA, 121 bp, Gadus morhua
ggaacagatatgatttgaacgatatgaatttgttggtatttctttcaaaatggcagttgamgtggtcatatgtataaatcaattatagatgatacatattatatgttaatgcatttctgat

SEQ ID NO: 2537 - DNA, 121 bp, Gadus morhua
gactttgtgtgcattatagcatttttttaaatctccattccagtgccatatttaaaaattrcatgcatggcagaactgtttttcccattaaataggtccctgtaatgacaacgcccccacc

SEQ ID NO: 2538 - DNA, 121 bp, Gadus morhua
tttaattataggtggtttttataccatatatacaatatgtcccttatttttacccacacaraatggtatttaactttgtaaagatatgcagagccggacaagtaacggagtacatttactt

SEQ ID NO: 2539 - DNA, 121 bp, Gadus morhua
gctagaagacactagtgatacggtcacctcagggagcacagctagccccacacccccccgsagattccccttaagattctgaaaacgcaatggtttctcatcagttccaatccttctagtc

SEQ ID NO: 2540 - DNA, 121 bp, Gadus morhua
aagtcaatagataaattgtattatttgtattgacaaacattcagaattagctcaacttacwtaacattagtctaacatcaaaccagagcattcacatttttgaacatcactcagttttgca

SEQ ID NO: 2541 - DNA, 121 bp, Gadus morhua
atgtgccattcgctttttctccacttcgtttttccatctcttccaagttacttttggtwcygttgccctccgtactattatgggatgtgtatacagttatgttcttatctggtgactcagt

SEQ ID NO: 2542 - DNA, 121 bp, Gadus morhua
accaaacaactaaaatgttgacaccaaccactccattttactcagctcactattaggactygcatttaaattccttcttgttaaggtttacttaaagttactttgctttaatatgcggata

SEQ ID NO: 2543 - DNA, 121 bp, Gadus morhua
tctatttttgttaggttttcggatatttgttcagtcagggcagctcttgcccatctgaccwatcccagttttgtccctgttgtggttctttcyctcagtgaatacatcccagctaccgcac

SEQ ID NO: 2544 - DNA, 121 bp, Gadus morhua
aacatacggctacagtgcaacagaagcatgccaactcgtttacccggcagatctaaaccgsgcatatactgatttacactttatgagttggaataatggggccggaaatgctgtccctcta

SEQ ID NO: 2545 - DNA, 121 bp, Gadus morhua
ggttaaggtggttcttcacatcactgttattataagttcttatatccagcagaagcacaarctcgaaaacggctaaaaacaatcacattcaaaggcagacagatctactattatcagagga

SEQ ID NO: 2546 - DNA, 121 bp, Gadus morhua
atcctacagtccagcgacaaacgagtccccagtactcgtattcagagcactgtggcggtgrtggaggtaggaggtggggtacctggaggaaccaacccaaagaccggccctaacccaaggc

SEQ ID NO: 2547 - DNA, 121 bp, Gadus morhua
taaaacaagtgacaaattctatgaagaacaaacaagttaaaaaaataataattattccacwcagaatgccttaggtttaaacacagcacaaaatttggtctggtttaaccatttggcaatc

SEQ ID NO: 2548 - DNA, 121 bp, Gadus morhua
tatctccaccaagtaaaaattatggcttttatattaaaatctcacccaatgggatcctttraacttgaacagcaaacgggtccctaaatgctgttgaagtaacatgtttcttttagataaa

SEQ ID NO: 2549 - DNA, 121 bp, Gadus morhua
aaaaaacgaacacactatttgggggattaaagtgcactatcaattacttatatattgctamatctctaaacagaccatcgttcaaaggctcttaggaaaacattaaaactacaagtggtct

SEQ ID NO: 2550 - DNA, 121 bp, Gadus morhua
ccaggygtgcacgttacagataacgacggggaacacaaagccactgacgtttcactgtcamagacgcgcattagcaccgcaggcgcgcttccattccgtttagcggtgagggagagaaaat

SEQ ID NO: 2551 - DNA, 121 bp, Gadus morhua
gaagcctgtgccctcctcatcgaagcaggcgaaggcgttgcggatgacgtcctccgggtcrgtcccgttaagcttctctccgaacatggtgaggaacatggtgaagttgatagggtccggg

SEQ ID NO: 2552 - DNA, 121 bp, Gadus morhua
attcaaaggttttgaaaggacagaacatcagcaactatctcaaaattgttacgcaaaaaawttgttaggtaacatggtcttctagttgggtagaaacaaaaaagtttagagttatgctaaa

SEQ ID NO: 2553 - DNA, 121 bp, Gadus morhua
ctacataacggcagctatagcgtcgaaccattttacgcagggattccagccacaattccakcctcgatgccacagtggtacctctccacgcagggtcttaaagaacccattatctccccaa

SEQ ID NO: 2554 - DNA, 121 bp, Gadus morhua
tccgggccaggcccagacgctccaggtctgcgatgcgtctttgcgtgtccgatgggacgcwggttgacctctgaacccgtagcgcttcatcacgccctggaaaccctttaccgatcgtctt

SEQ ID NO: 2555 - DNA, 121 bp, Gadus morhua
aaacaaacacgcatacatacctcttgtcccatattggatataaggaattgttgatagtgtwttcacttgtgtatatggagacaaaaatgcaagtgatgtgtatcccataaattgagaacaa

SEQ ID NO: 2556 - DNA, 121 bp, Gadus morhua
catgtttctttttataatactctcttccaactaacaaagttactttcatttagattaaacygttaccaaccagtgaacttggacatttacaggcaacctcgggtagtctggccatcttgat

SEQ ID NO: 2557 - DNA, 121 bp, Gadus morhua
ctcctttagggctgcaataacgtcccgcaggtcctctgcattgatgggattggccggtccytgtagttccacctgaggctgaaggtctcccagtaacgctctgatgttgctctgattgtgt

SEQ ID NO: 2558 - DNA, 121 bp, Gadus morhua
ctggttgggcagacttaagtgtttggatcagaattcagatcaactgtagaacagaatatamataacaaagacaaatgcaaaacgttatttcaacgaaaacttataatgggcgcctagggca

SEQ ID NO: 2559 - DNA, 121 bp, Gadus morhua
actctatcggcatcgtcaccaactgtggcgtacattaggtggcacaaggatatgcttcagstcagacgccatctgtacatgtacctcggcaaaaataaacacaaaaagattacaaaaatat

SEQ ID NO: 2560 - DNA, 121 bp, Gadus morhua
aaggattgacaacatgcacaatttcccataagtttttctgccccacactagtaaaaaaaaraaaatacgaaaagtagcatagagtcgcagaaacgaccccatcataaagacgaggttagat

SEQ ID NO: 2561 - DNA, 121 bp, Gadus morhua
ccccgggcccttcatccccttgaacagcctctctgctagataggtggaggtgctcttcgcrcacttcactatggcgaccaggagatcctccagattcccggacatctccccctcgatgctc

SEQ ID NO: 2562 - DNA, 121 bp, Gadus morhua
atgatttatgaatcagccacaagcttcaaatagggatcactgccggtctagtttgaccttyaaccataaagaattaatgtttttagggacaaaatatattctctataaagaaaaacaggac

SEQ ID NO: 2563 - DNA, 121 bp, Gadus morhua
aaaaaaacaaactatgattaaattgttagcctaaatttccagtgtctgatgacgttgcttygttacctgtaagtattcacaaatattaacacagtcaattgattttaagaagagcaacatt

SEQ ID NO: 2564 - DNA, 121 bp, Gadus morhua
aaagcagaataatcctgaaaattaaggaaaaggaaagccaaaaaacttgaattgtaatttsgttttgttataacaaacaacaatgactgttgcattacactcttaaatactgacatgtggt

SEQ ID NO: 2565 - DNA, 121 bp, Gadus morhua
ccagctgttgtgttttaggcaaacaaggaaatccattctctatgtgtatattatcattaayttgaacgcattgtggtcacactttagggtgcttgcacagatataactgacatgttgtttt

SEQ ID NO: 2566 - DNA, 121 bp, Gadus morhua
gttaaaggmaaatgcagtaacaaggccatttgtgaatggagattgaaaagtaaaaaataawttacgctcagacaaaaaccataataaaacaggcacttttacagcattaaatataggccac

SEQ ID NO: 2567 - DNA, 121 bp, Gadus morhua
acttcaaaaccatcagcaatgaacccgagttcatactatgtcatttagcaaaggcagtttktaaatttttaactttttttaccaaaatggttttatgcaatggccagtgatatatgctaag

SEQ ID NO: 2568 - DNA, 121 bp, Gadus morhua
ctctctctctctctctttactcccaaggattgagctgtacagttggtaaaaaaaaaaaaamaaaaaacaataaaacaccctgtctacaggaacctattttaaatgtttcttaatgtattct

SEQ ID NO: 2569 - DNA, 121 bp, Gadus morhua
gaaattccggagcacggttacacaattatacatgatacaaactaataaaatcccagttttyttcccccaagatataaaaataagtcaccgaaaaaacacacatgcggtacgaaatggaata

SEQ ID NO: 2570 - DNA, 121 bp, Gadus morhua
tgtattccctacatctttaactgcaaaatatacaacaaaatagattcaatgtataattttwaatctttcctgatttctccttcctgccttattgagttataacactggaagtaaggaaagg

SEQ ID NO: 2571 - DNA, 121 bp, Gadus morhua
gtaaagatgcatggcgatatttacaggagcactcgacttatttattactaaacagaaaaamcatgatttttctccctcctcagataggttgtgtgaagatatgactcgcatattaacgaga

SEQ ID NO: 2572 - DNA, 121 bp, Gadus morhua
aagaggctgacaccctccatttagagccaggtttgaacaaaacaacccccccccccccttycccaaataaaatcttttgagatggagtgaacgctgtgaaacattttgggaaaatcaggta

SEQ ID NO: 2573 - DNA, 121 bp, Gadus morhua
ttccagtggattgatgttggtaacctctgcgttttaacccaaacatgacagtaaccgccgwacaatatatcttcactgttataaaacaatgttcacaactgaaagagaccaacccccaaga

SEQ ID NO: 2574 - DNA, 121 bp, Gadus morhua
tgcatggtgtacacgctgctgtacatcatcctgaaggattggagctcgtcctccgtctcaytcacagctgcggagaaataccacctcccaaggtactcctctaggttgaggctggctgcgg

SEQ ID NO: 2575 - DNA, 121 bp, Gadus morhua
agctacacaataaagtccaccgtgacatgccgataacatggttattgtgtagtctttcggyagatttttaaactaaacgaaataacatgacgacttgcagaggagcaactgacaaaacaac

SEQ ID NO: 2576 - DNA, 121 bp, Gadus morhua
ttgcacccaacataacagttaacgttggagtgacaactcgtgaagcagtaagatagttccraagacaacacacagaaataataaattaacaattttttagttgacatcaaacactcttgtt

SEQ ID NO: 2577 - DNA, 121 bp, Gadus morhua
tttatgtcaatgtatcctctgttcctgataaactctcccacgttccgcttggtggaacacmacgatatgacatgggatccactccgccggcactccgtgcgtctgtcctggtctgccacac

SEQ ID NO: 2578 - DNA, 121 bp, Gadus morhua
ccaaacgacgctttatcttcatttgttacacatgttctacaactaaaatgaaataacagtrgaaacacaacaacgcttatgctacacaaaatggttttacaacataacattaaaaatgcag

SEQ ID NO: 2579 - DNA, 121 bp, Gadus morhua
aacagcaggattcagaatacagtttgtcacgcacacgcacacacacacaaacgtgtgggtkggaaagattttccggaatgcaaagagaaaccgtttggaccgatggacaagtgacgtggat

SEQ ID NO: 2580 - DNA, 121 bp, Gadus morhua
atgatcaagtgcattacaactcactcgataaataccattttggcaaagtatgccaatgtcyccaatttatgccgtatcccgacaaaaatgccactgggtaaattcgctccttacaaatcaa

SEQ ID NO: 2581 - DNA, 121 bp, Gadus morhua
tagtatttgcattcagctggggctacaatgtccatgggtgggtggtggaaatctttctccyttctttgaatcccgggcctgacagatgggaccattctggggtctcctggaacatggtgtc

SEQ ID NO: 2582 - DNA, 121 bp, Gadus morhua
gcataaacacttgtatacaaagcaggcaaacacacacacgcctacacacaaacacgcttayacacgcctacacacaaacgcgcttacacacgcctacacacaaacacggatacacgcgccc

SEQ ID NO: 2583 - DNA, 121 bp, Gadus morhua
gaacaccaaaccatagaaattcaaaacactactttaaatgcattctgttcacgggttgaaycgtatggaagccaagggaacagcaaaatgcaatttacatgcgaaatgaattgaagtcttg

SEQ ID NO: 2584 - DNA, 121 bp, Gadus morhua
tgttaccataaatctcttgtggaataaattccaccatcgatatcatacgtggattttgcaygagatgcatgaaaggattgataaaataattaataaacattccacaattctttttatcacc

SEQ ID NO: 2585 - DNA, 121 bp, Gadus morhua
gtgttaaccttgtccccaaactcttttctcacggtgttctagaagaatcccctggctctcygggcccaatgaacgaacacgcctcccaggatgaaaccctcggcgatcatgtcgccctggg

SEQ ID NO: 2586 - DNA, 121 bp, Gadus morhua
cccctttagagaaaatgccacttgtacaccccaggagacaaaggaagggcgtaactcaacrcaggagccgattcaaccacatttctggcgtcctccgaactgaacgtgaaggggctctcac

SEQ ID NO: 2587 - DNA, 121 bp, Gadus morhua
ttattttattgaaagtattgcatagtttacaaatacctccactatgacaagctccatgaakgtaaaaaaaataaacagaaataaaatgaagacgcttttattttaggaagttgatccgcac

SEQ ID NO: 2588 - DNA, 121 bp, Gadus morhua
ggcgtcttagaagtttgaagtctcctccgtccagcagccttctgtacgtggcgatctctgsctccagcgttcattttcattgtcgagcagggcctcatactcctgtgtctggttctgggat

SEQ ID NO: 2589 - DNA, 121 bp, Gadus morhua
aggatctttctgagagcagttagaatcagcatatccacttcgtccttcaattcgatttctstatggtagttcttcagggggaaagatgcagttcagtgggaatcccacggtattactgagc

SEQ ID NO: 2590 - DNA, 121 bp, Gadus morhua
tgtcttcttggcaggtacaacagagaaaaaaatactaatcactgataaaatcgtgtcgtaraaattcataagagaaaaatgcgtgtaggactcggcagttatcctgcaggaccgcctaata

SEQ ID NO: 2591 - DNA, 121 bp, Gadus morhua
ttgtgtgtgtcacgagaataatattcacgcactaatgttcacttatttttgaatttgatgraatgaaggcttctctactctgatcattcatgaatataacggcggtcaacatggcccgaac

SEQ ID NO: 2592 - DNA, 121 bp, Gadus morhua
tccccgcatttgcgcacagtaaaactcaagatcgtcatccgaggtacatttattggaaagytgtgccaggcgcaccatctctgaggagaaagcctcatccaggtcaaacaggtccagcata

SEQ ID NO: 2593 - DNA, 121 bp, Gadus morhua
gaaatatgaaaaaataaaaccaagaaatcatcacgtaaaccattgtactgcagacacgatkgatttcgattttggtccccctagttggagagaagtgcttgtttaattacacagtaacaat

SEQ ID NO: 2594 - DNA, 121 bp, Gadus morhua
agagcgcaattaaattctaacaatcatgtagccaaatattgattaggacattaacgtaaarcaaatgatttgtctgtcggaagtagagccaaattaacctttttcttaggaatggtttgga

SEQ ID NO: 2595 - DNA, 121 bp, Gadus morhua
ctcacttttacccaacattacattgttgtaaaattgtatttacattagaagaacacaatawgagacaaccccattgtaatccaattggaagagcaatgtactcacagtttcagtagatcag

SEQ ID NO: 2596 - DNA, 121 bp, Gadus morhua
gataaagtgcattacaactcactcgtaaaatatttttttcaagtatgcaatgtctttatamttttttctcaaaatgcattggatatccagcctcacacccaatgacaatgttttgggcata

SEQ ID NO: 2597 - DNA, 121 bp, Gadus morhua
catccgatctttgaggaaacgtctgcagcatattgtacggctgatatgtcgttctcttagwatgcctgttgaatattattgtttgtggaaagcaatttcttggttcgacgtcattattaaa

SEQ ID NO: 2598 - DNA, 121 bp, Gadus morhua
gaccctataaacaagctgctttgctttggaatagtcccaggcgggatcaatagtaacaatkgtgcataaaactgccagcagttaacgtttacagattatgaacagtccacttgaagttcct

SEQ ID NO: 2599 - DNA, 121 bp, Gadus morhua
gttgatattgggctgcaataaagccagtcttatacaaacatatacaccagaacataacatrtaggccgattttaatagatcaactcagaatttatttgccagtgtatctaaaagacagtat

SEQ ID NO: 2600 - DNA, 121 bp, Gadus morhua
attgtaattaactttctttaaacatgacatggtgctgccagctgcccagtgggtgagcccrgtgaggtaactgatgggtctttccacacacttttcagggaatgggcattttgttgtgcta

SEQ ID NO: 2601 - DNA, 121 bp, Gadus morhua
actcatccacatcgaaggctatctccctcagttcctccaagttctctgggccctttccagygagcctctcaatcatgtcagccatgtattgaacatgttgcgcaagttcctgcagttcctc

SEQ ID NO: 2602 - DNA, 121 bp, Gadus morhua
tgagacctccttccttctcgggcgtcccggttggagatcttagttgtcgatcaggttgtgyagggccaccagcggagcggatagagggaggccaggtagaccaccagcatctggtcagtgg

SEQ ID NO: 2603 - DNA, 121 bp, Gadus morhua
aatggagaactgtcttacttcctgtaaaatgtaatatgcttgatcctccaataaaaagatktataaaaaaaaaaaatgaaaatggcccatttctccggacttggactcacaaatgtgtaaa

SEQ ID NO: 2604 - DNA, 121 bp, Gadus morhua
gcaaatagtcaaagcctatatgtaaagtttgcaaattatacaaagtgagattgagaatttmaatgatgagggggacggggggaaggggcgatggatttacaaaatactcttcgactttcaa

SEQ ID NO: 2605 - DNA, 121 bp, Gadus morhua
atgttttgagaatgtcgtcggcaaacaaccccatcctttacatacacacaaacacatacakcttgcaaataaacaagcaagatttctcttgttttatccagtacaaacccaaataaataac

SEQ ID NO: 2606 - DNA, 121 bp, Gadus morhua
atcttgtattacacaaggcatacaaatacatttcccttttatatgaaaaaaaaaaaaaaamgttcaaattttttggttgaagtcctttaactcgaactataaagtgcaatagccaccacaa

SEQ ID NO: 2607 - DNA, 121 bp, Gadus morhua
accttttcaacattcagtgccagtttgacattttctcgttaaggtgccataagaaacaatrtattaaatattgagctgaattatgacacagcgaccaaaaatatttccaacatattaaatg

SEQ ID NO: 2608 - DNA, 121 bp, Gadus morhua
tcaggacctcctgccgcaaatgacatgaatttgatccaccaaaacgcgtcacccagctttrccaaattatcagccacccactgccaaatatcagctataaggtggttggtcgatcagtggt

SEQ ID NO: 2609 - DNA, 121 bp, Gadus morhua
ctgtctgatgatgtcctgggatctaaaataatttaactattttaaacaaacctggtaaaamaaacaaggttcaaacaactatggaacagtgacagttgcaggttaacaacggagggtgtaa

SEQ ID NO: 2610 - DNA, 121 bp, Gadus morhua
actaacaccttgtatcactgtgccactggcctgttcctaaactagaaatgtgaacccaaaragacgctaaaatacaccaacattctacattaccccacaaaacaattcaagagcttaaagg

SEQ ID NO: 2611 - DNA, 121 bp, Gadus morhua
gctaattggtcacccgtttctactttcaccattgaattctgagaaattgtgacaattcacrgatacatttaatgcaagtggtgttgatctgaagggcaaccggaaaagaaaaattcccaag

SEQ ID NO: 2612 - DNA, 121 bp, Gadus morhua
tgtacgagtcacttaaagcccatacgacgagcggtttccaggatcgataagctataaaaamaaacatttctcatgagctcaatttctcttagcccctcccaatagtagagaggagtgcatt

SEQ ID NO: 2613 - DNA, 121 bp, Gadus morhua
atttatccgagcagagatccttgaattgtacaaacttgtgtgtgcccttcgtgcgtgcgtstatgtgtaataaaccactcaaaacctcagtttcattgtccgcgattccacgatttttgtc

SEQ ID NO: 2614 - DNA, 121 bp, Gadus morhua
tatgtctcgaccttagaaaaaatcacggctcaacaataacaaaccgaaactcaaagtgaamaacaaatcagtagtcacataaacaaggcctttttgctactaagcaaacagttgacaagag

SEQ ID NO: 2615 - DNA, 121 bp, Gadus morhua
tgggcccagtcccatacatttcgtaggaatttcgctcttatcttgtcctcctcatagacawatatcagccacagaattcatctttctatgtaaaagccatactgtggcttcacactagacg

SEQ ID NO: 2616 - DNA, 121 bp, Gadus morhua
caaaaaactaattttaacggacttttaacacccattttattggaccccctaaatctgaagsaaatgactttatggatgcgacatgttcaagaaagagcaggtatgggtcttaaggccactt

SEQ ID NO: 2617 - DNA, 121 bp, Gadus morhua
aacacattcgttttcaaagattttctctatgctacttctctagctatgttcacagatacawttctacacacaagcatgctttctctctatcgatctttctctactctatttttcctaactc

SEQ ID NO: 2618 - DNA, 121 bp, Gadus morhua
gtgcttggctatcaacagatacacgtagtagatacttaaatcgcgaacccgatcgaccacyggaactggataaacgaaaagggtagcagttaaaaaccaagatagaataataaaaaccaca

SEQ ID NO: 2619 - DNA, 121 bp, Gadus morhua
ggtttataaaaggggcagatgccacaggctcacacaatgtagccaaggcactcaactcttwgtgtgtgcggttgctggaagcagtatttggcatgtcttttgagtccaccaaccagtaccc

SEQ ID NO: 2620 - DNA, 121 bp, Gadus morhua
cttaaaatacttaatacttttcaaagcctcatgagaaataggcacacaaaaacagggaatmtgtttcctgataaggcttttgctctttatttgttgtacctagaagaaatgagttgaactg

SEQ ID NO: 2621 - DNA, 121 bp, Gadus morhua
ccatcccagatgctccagggccttgctgctgtccccttgcaggtattccacttcagtgggrcggaagcaatttggggtcgactctcacaagaatggctcctgtcctccttgttacggccaa

SEQ ID NO: 2622 - DNA, 121 bp, Gadus morhua
aacgattatttttggagttaaaaaacatgaagtatttattctctcccaaaaaaaccacttygtaactgagaactttgaaattctggccttaaaaaaataccacaaaatggtcaaaatacaa

SEQ ID NO: 2623 - DNA, 121 bp, Gadus morhua
agattgtagggatgacgatgatcaccggcattgtaatacaacacaccgtatttcccaagamcatcgctgcccagcttcttcttggtgtagacattgttggcagctgtgaagaaagtcattg

SEQ ID NO: 2624 - DNA, 121 bp, Gadus morhua
gtgggacaaccagcatatacatacgatgaaaccgacaaagaaaagaaagaaaaatcactcmtttggttatttcggaatattaatcaccgcagtagcatttccacacggtccacacacacac

SEQ ID NO: 2625 - DNA, 121 bp, Gadus morhua
agtaaataaagcttcccttgaatattttctattgagtcaagcaattagaaacaacatcgamgtaagatacagaaaataaacagaccaactcttattacttctatggctgtagtgacgcatt

SEQ ID NO: 2626 - DNA, 121 bp, Gadus morhua
attgtctttggagtttgggttaattgctgatgaatgaaatctccatgtggtatatttagaytaaccatgacaacaaaggttttacctgatgttcagtttggatcttccccatgggccttgc

SEQ ID NO: 2627 - DNA, 121 bp, Gadus morhua
atttctaaatggtatacttaaatggaccattaaccaagtggacccaaaaccattttttttkgttttggttccccattccagggttatgcccacctcccaggggaattaaaggaatcagctt

SEQ ID NO: 2628 - DNA, 121 bp, Gadus morhua
gccgccctgtactccatctgcagtttgagtggacgcgtggagaccctggatgtttctgacwgtggcgaaattcatcttctcctggttcacttggaaagttcttttcagacagctccagtgg

SEQ ID NO: 2629 - DNA, 121 bp, Gadus morhua
tcaaatcccgatccaactcaataagccatctatcaagtcaaccagatcagtctagtttgamattttgtcataaatcattcaacaatcttttattactgagtgcaccataacatcaatcttt

SEQ ID NO: 2630 - DNA, 121 bp, Gadus morhua
ataaaataatatgaagggcattaaatatttatacaactcgtatattcaaacaataggatayggtatgttcaaaatcaaacacattccactattagaatataacagcatgcagtataaaatg

SEQ ID NO: 2631 - DNA, 121 bp, Gadus morhua
acaacgtcgggtcgcgccataaacgaggcagtttgacaggaacctggacaaacttttgatratataaaaaaaaaaaactatttaacggatgcatcatatttaacagggattaaaaaagaac

SEQ ID NO: 2632 - DNA, 121 bp, Gadus morhua
tcctcttgcaaaagagatttgtcatcctcccaaatatccctgacccttcctcatgaaagcrtatcatctcttggctgtggtcaattacgaatatcttggaggtcttttattctgttatcct

SEQ ID NO: 2633 - DNA, 121 bp, Gadus morhua
ctatgtcgttttggaggctataggtgtgtaaataacacgctactatactaaacatttaaargacattgcggtcatcaaaccaggtactttgtggacgtcatttggtaaagttgagtgcaaa

SEQ ID NO: 2634 - DNA, 121 bp, Gadus morhua
gatgtcgacagcaagaacaaagaccaagatgtgtgctttgtcatttgaagtggggttgttsatgtagccagcgtttgacttgaccaaaggtgyattatgatcgaacttgtaattctctttc

SEQ ID NO: 2635 - DNA, 121 bp, Gadus morhua
ctctctgggttttttcatgaggtaggctaggcggtgaaccaagcctgaccctagttttaayacaaagctctgaagtccatgagagacgcagccgttggtatagttggtgtaccccacggtg

SEQ ID NO: 2636 - DNA, 121 bp, Gadus morhua
tttaaaaaacaacatatgtaaatcgccatcacttaaaacaaaataaaagtcccaagatcawccgcttattaataggttttggtttttccttttttggtgaaactatatcaaaccgatgagg

SEQ ID NO: 2637 - DNA, 121 bp, Gadus morhua
acatttaaaaagcatagtaaagattaagtccatttccttgggtatatagaaacaagcagawtacaaaaggagttggtacaagtaacctaggagaatacacccgtgttcaattttttttggc

SEQ ID NO: 2638 - DNA, 121 bp, Gadus morhua
atataagtgcacataatcaatgtgaatggcaatacactggacatttccatcgatattaatrttacgattttttctttttggtgtgaaaaacacgaaaatacttttgtattcgtcagatcaa

SEQ ID NO: 2639 - DNA, 121 bp, Gadus morhua
tatgttcaacaaattctgtgaatacaattagaattttatgatagacaggttggccatgagwtacaataaagccatccatttggtatgatatgtacaaaatttgccaaattcttctaaaaaa

SEQ ID NO: 2640 - DNA, 121 bp, Gadus morhua
gaacatttgacaaagagctgtcctccccgaaacaggaggacaccctccccctcccctcaaraccaacataacaccatgaaacagaccggtgctgaactcaggaccctatgaggtccagaac

SEQ ID NO: 2641 - DNA, 121 bp, Gadus morhua
cacgcaagtacataggatggaatttataggcagcaaaaaacggtatatacgtggcttgggyaaggaccgctaagtgtgggaatttggacaaaaccctcgttttcctttaagcttaactgtc

SEQ ID NO: 2642 - DNA, 121 bp, Gadus morhua
aatctgtggtagtacatttgaagcttttattccaaaaggtttttgagggacatccataagwtatgtcccaaggcactgatttatttacgcaaagtatctccttaagcacatatattatcat

SEQ ID NO: 2643 - DNA, 121 bp, Gadus morhua
aaataagtacgagagttggctttcaaaaaataataatgtaaacattgggcatagactttgyagccattacttcggatactattaactgccaaaccgaacagtaccaatagaggttaaaaaa

SEQ ID NO: 2644 - DNA, 121 bp, Gadus morhua
tcaagactattttcttcattcgttcttcagtcgttttagacagtgttgtagcgtcgataamccatatgatgaacatcttatgaagccagtatggtgtcattttggaagaatgctgtttccc

SEQ ID NO: 2645 - DNA, 121 bp, Gadus morhua
tttctgatcaaatttatatagtctttaagctgcaaaataagtttgaaggcaaaaaccaaartaaacatgatgttatggttatttttctttcctggcatcaatggtttaacatcactcaacg

SEQ ID NO: 2646 - DNA, 121 bp, Gadus morhua
tatagcacacatcttaggccgctagcacccctccaacacatcccaaacagttctgatgtaraaggacccataaggaagtgaatgtttagaagtcaaccgccacggaccttcgtcccaggcg

SEQ ID NO: 2647 - DNA, 121 bp, Gadus morhua
catgttcaaaccctccaggttcccatacatgcgaccattaatggtgtgcatcttgttgctytctatgaagagctcggttgtcacttcagggcccctgggcgggttcacggatttggggttc

SEQ ID NO: 2648 - DNA, 121 bp, Gadus morhua
tcacggcagcatttccctggtcaaaattacaggggagacatcatgaaaaaacttgtccctyctattaaaaaattaaagaatgttcccaccgaatcccttttagcaagaagttcaaatttta

SEQ ID NO: 2649 - DNA, 121 bp, Gadus morhua
ttagtgaataatacagaacagtgcaataggacataaggaacttcataaattaaaaaaaatkgccaattaaatctcaatcgcaatrttgttcaacaataatggcaattcgattatttcccca

SEQ ID NO: 2650 - DNA, 121 bp, Gadus morhua
ccaacacatccctactggttaaatgaagaacaagagtgatataactagttcaacctcttawtgagaattgcataggtgtggctctggaacttcttcagaaccgctggtcrctggccaattc

SEQ ID NO: 2651 - DNA, 121 bp, Gadus morhua
gctggcaaaggcgctttcttttgaaacatttctctttttctcttagatttgtcatttggcrttttttcctcttctcttgttttcctctgcatggactcccatcttcttcttgatgatttca

SEQ ID NO: 2652 - DNA, 121 bp, Gadus morhua
aaatggaaggatatattggatccatcaagattacaatctaggaaaaactaaattctctcawttgaaaatccgaaataaagtctgcagtaacagacttatttacaatctatgtataccattt

SEQ ID NO: 2653 - DNA, 121 bp, Gadus morhua
gcttttaagttgtaaacaactgtgcactgcaaagacgacatttaagacttgggtttttttycatctttttttttttttttccttttttagtactttcccttttaaatatcacaatgtgtca

SEQ ID NO: 2654 - DNA, 121 bp, Gadus morhua
aactcaaaacttttggcttcttgagcattttgacctttcctgacgataaacagtcgtgcarggggatagatggactggcatgccttctcaatgtccttgccaacactgtctgggatcagct

SEQ ID NO: 2655 - DNA, 121 bp, Gadus morhua
aggtaatagctataacactgatgggattgatagaccgcacaatttaatacagacacaccarttacatcctacacaactacactaaaccgactgggcacttgctcattcacatctttttttt

SEQ ID NO: 2656 - DNA, 121 bp, Gadus morhua
ttgattatacagctcttcctgtatgtcacatatttaattcctgtctatctaatggaacctktcctaaaatctggaaagaaggaaaaattrttcccataccaaaagataccgaatccacatt

SEQ ID NO: 2657 - DNA, 121 bp, Gadus morhua
aagaagtggagtaagtggcaactagaaggaatgctttcaggacaaacttccatacaacatkaaaaacaacaaagaagaaatctgtggacgaaggtgagaaagaaactaaatgttgcctcaa

SEQ ID NO: 2658 - DNA, 121 bp, Gadus morhua
ctcatcgcaggtgtgtcacatcaaactcttatggagcaggtgagcggtttaccagatcagscaataagagggcatgcaaaagcatttgtttaacctagagttattcaaaccaatcttctgg

SEQ ID NO: 2659 - DNA, 121 bp, Gadus morhua
gaaagtgaattttccctctcaacaataagataacatttccccaacaataacgttttaaacraagaccacaggacttacaaaaagactaagtctgtcttcaaatgccagtctccaagatggc

SEQ ID NO: 2660 - DNA, 121 bp, Gadus morhua
gagtaaagttaaacgataagccttagttacacacataattaacatgataaccaacagcaaktagaaggatccatgtgtcacttgttrtgttttatcaccttgactggagtgcagagggaag

SEQ ID NO: 2661 - DNA, 121 bp, Gadus morhua
attcccccattgggaaacaaaaagatgctcattaaatccaaaagccccttaaatttggttwtggttttgcaaccaccttttttttctgtagtttatttcccatgatgcattgcaaatggta

SEQ ID NO: 2662 - DNA, 121 bp, Gadus morhua
taggctcaacagctggagatactcgtcggctcccatccgccaagcacttatccactaccgscatcttctctgtggatggctgacttttttcttgtcatttagggtcctgttcaaatgatgc

SEQ ID NO: 2663 - DNA, 121 bp, Gadus morhua
gccattgaggctagattgtccaggaagaactacaacagacaaggttgcgggtctgggaggkatttaaaaagttttctcaaggcgatcatccaacttcttcatcacgccctccatttttcca

SEQ ID NO: 2664 - DNA, 121 bp, Gadus morhua
atggaacagttgtcaggaaagaataaaccatttaataaacaggccaaatgtgtaaaaaaawaaaaaaaagcagttcagtcagattcagaaggtagatcgatagtcaactcgctgatggtct

SEQ ID NO: 2665 - DNA, 121 bp, Gadus morhua
gaaaacaaagaaaagctaaaagtctgcgttccccattggcgatgctttagggattcattastttgcattggtttggattccgaaggggggaaagggccaggtgcttaaataacagatgccc

SEQ ID NO: 2666 - DNA, 121 bp, Gadus morhua
caactccgggaaaccactttccaaggaataactccatttaggtaacttcatgcaaacaaamatttgggcaaaggttatatttcgtatttgtttgaactaacagccttcaggcgtgcaccta

SEQ ID NO: 2667 - DNA, 121 bp, Gadus morhua
gcagcaatgtattcttttaatgttgatcagaatttcattccattaaaaaggatcaccattmaaaaatatagaatattggcacaaaatataggcatcctgcatcggcccgtaaaaccaatga

SEQ ID NO: 2668 - DNA, 121 bp, Gadus morhua
attctgggggacaggagttcgtttgggcgacaatcactgcgagagaataggtgtcatgacmagtttatggaggaaacgtccgaagccagaacacatcaaagatagaccaagtacagtgact

SEQ ID NO: 2669 - DNA, 121 bp, Gadus morhua
tgaaatctcggacataacataggcaacaaaagtgcccttttaacaataatgcacttttttwaatatgtgtatccgttggtttgtaccagtaaataaagacagggcagaaattaagcaggat

SEQ ID NO: 2670 - DNA, 121 bp, Gadus morhua
ataagaaagtcaggcaatcacccccacaataaaattcgagaattaaaagtttttcctgctwtaagctaagcaatgctgtggtatcactatactagcatccagaccttcccaatggaatgtc

SEQ ID NO: 2671 - DNA, 121 bp, Gadus morhua
ctgtgagagttgtgctcatttaataaaggaaaagccagaacttcaccaaaaaacaccgatyatctaaatatattacattgccacttttcccttttggtgagttatgtataccagatgttat

SEQ ID NO: 2672 - DNA, 121 bp, Gadus morhua
taaagatccattaaagaagagacgtgaatcacagattgcccactacagtccctcgagagasacacacacacacacacacacacacgcacacacacaccaatagattattttttatgccaaa

SEQ ID NO: 2673 - DNA, 121 bp, Gadus morhua
aacctgacaagaaagataaacaatgggcacttattttatccctccatttgggcattaaacmcactggcattcttaaaacagggttgggccagcattgatctgatcacactcttcctttgtt

SEQ ID NO: 2674 - DNA, 121 bp, Gadus morhua
acatctttgaataatattcctgtaaattcctctgttttattggtcccttttgtgttcactwttgcatggtggaaagtgacaagatactttgtatacaagttttgtatcaaaagtcttacat

SEQ ID NO: 2675 - DNA, 121 bp, Gadus morhua
ctacaattgaaaacactaaaggttggggtttcgattcaaaaggaaaaaccgtttggatacmgatttagccgtaaccaaaacgtgaaattattccatccttgtggggaaagcacccaatctt

SEQ ID NO: 2676 - DNA, 121 bp, Gadus morhua
tcattcagcataaatatgttcttatatttcattgcaaagcatttttgtccattattgcccscctcggtaactttgcaaggacatccatttaaaatgtgattgtcttcatcacttgccttga

SEQ ID NO: 2677 - DNA, 121 bp, Gadus morhua
attaaccccaccattctctacctgtcgacattcagtcctctccaaaaatgttaacaaattktaatactggcataccaatgataacccctgaaatgttgaaatgaacaagctggtacttaaa

SEQ ID NO: 2678 - DNA, 121 bp, Gadus morhua
caaatagggttgattttatttacagaaaaatagagagrcggccaagaaggaccaaagtccygtttaccatgaccaattcgttggtcaatgatcccggagaagaggagtagagaagggtaga

SEQ ID NO: 2679 - DNA, 121 bp, Gadus morhua
aatatgaccagcccaactccaaaacagatggtgtttgagcttcgccaagtctatgcttaamacatcaatcacccttcttggcatgaagacatgaacattcctgtggtcacaaaacaaaccc

SEQ ID NO: 2680 - DNA, 121 bp, Gadus morhua
gccctggcgaaagttcggtagtcctctttgaacttctgggcttcttctaccaacggagtcmatgcagcaatttgcaaatccagtatctcgttcgtctgcttattcctctcctgaagaaggt

SEQ ID NO: 2681 - DNA, 121 bp, Gadus morhua
gctaactaattaagacacgtttcattgtatgttaaactatttcaaagctaaaccggttgayagttttacatgaggcaaaatacatagattttaatctgtatcgtaaaacaacctccagcaa

SEQ ID NO: 2682 - DNA, 121 bp, Gadus morhua
caattttgatggtttgcggtaacagctgtctcccatgaatgctcttacgacccttcagtakgacaagaaccgtttttgccttgcacacgacgatggtgttgccgtccttcgtcatgaggtt

SEQ ID NO: 2683 - DNA, 121 bp, Gadus morhua
aattttcattttattgtcgataagctgaacatctcattcaaaaatcctgttcaaatgcaawgttgctgcagagctgtgtgtctcctttagaggggagggaaacacgtcgatgtctggttga

SEQ ID NO: 2684 - DNA, 121 bp, Gadus morhua
actcggccacagggctgtccgacagcacggtcacgctccagtcccttctgcttgaaaccgsccaacaccttttcagtccactgaaactgctggtcttcttctatgtagccgctgatctgac

SEQ ID NO: 2685 - DNA, 121 bp, Gadus morhua
aatttcatcaaaattgctaggtaacaaaacaatgttctggatcaggcaaattatgaaaacsagttttaacttgtcaaaacaagaatgctgaaaaaaaaaaaaacccattttagtcctcctt

SEQ ID NO: 2686 - DNA, 121 bp, Gadus morhua
acatgacacatttgggtccggtaatgatgcgctttggcctgaccaaaatatattttaaagkgggtgtggcggctgtttgccttgtggtcggtcattagcagtttcagacaaaagcaaccgt

SEQ ID NO: 2687 - DNA, 121 bp, Gadus morhua
aagcaggttatgtgacctcaagcaaaccaaaagaaaagaaaagacgaataaaaaccccatwtgaaaggtcacttggaaagcaaaaaaagaacgccctaagtcccatcagcgtgatgcgagc

SEQ ID NO: 2688 - DNA, 121 bp, Gadus morhua
tggtcggcgaatgctgaagccgggtctgcccagaaccacgtagaagtccagtccgtagatmccgatgctggggtcgtacttgatgcccagatcgatgtgctcctggatgccgaagccgaag

SEQ ID NO: 2689 - DNA, 121 bp, Gadus morhua
taccttattatacaaatataatcattaaaaagataagcctaccctttgatctaatacaaamatatgaacccaccccatgatgccattgtttcacacaaaacataatattcctgattgagga

SEQ ID NO: 2690 - DNA, 121 bp, Gadus morhua
caagaggccgatgttacaacaactagcatctataatttcagatgctagttgttgtaactcwataaccctgtcttgggattggaaacattcgcatttcaaagagtatctcaaaatacatcta

SEQ ID NO: 2691 - DNA, 121 bp, Gadus morhua
rtagaaaaaaaacacatacacacacacacacgcaccaaattcctttcagatttaaaaagcygttgcatcgccagtcccgggaatccatggacaatgggagggtcaaacaaacggtactggt

SEQ ID NO: 2692 - DNA, 121 bp, Gadus morhua
gaacacgacacagggtacaccacacttctgcccttgagcatccggcttagaataagtatcmtgggcggaataaatttgcattgacagcaaacatatgtgccattgcccaaagtgggcaagc

SEQ ID NO: 2693 - DNA, 121 bp, Gadus morhua
ggcacttgttttttggggatggtgttcggttggtccgcgctcccttcctctgatgtatttkgttttgttttcggtatccgcctcagatttaaggcggatttaaaatttaacgcatatttaa

SEQ ID NO: 2694 - DNA, 121 bp, Gadus morhua
gtagtgtgttggggggttgagagcagcattgaggcgtcagcactactaccctactacgagrggatcaacccgaacttgccatctgctgtaggagtagcatggctgtaatccccacaatgag

SEQ ID NO: 2695 - DNA, 121 bp, Gadus morhua
caaccttatctttaggggatgaatttcagtgagctgctgaatattcagaaagcgagacttycccttttggaagggcccaatcgttcacaaactcatggcccaaatccgtttcccgcacttc

SEQ ID NO: 2696 - DNA, 121 bp, Gadus morhua
cgtcttcataaccagataacaccccagcacagcgcttgcttaagaagagcatcttcccagkaccccggtgggatggtagtgcaggaacactggtttctgtacagaacagtatatgcccttt

SEQ ID NO: 2697 - DNA, 121 bp, Gadus morhua
aggcgtactcgtgcttcttgatcagatgtcgcaaggaggttggaactttggtagtggttaracccaatcacatcccggtcattactcacactttaaatgtccgtgtccactgacccgctct

SEQ ID NO: 2698 - DNA, 121 bp, Gadus morhua
aggattaaagataatccattgaaacacaaatcaccacagtggtctaatacacaaaaaacamacacagcaaaatgacacacgcaagttagagaaccgttttgtgaaagacatgcctgctttc

SEQ ID NO: 2699 - DNA, 121 bp, Gadus morhua
gggctacattgattcaaggtacgggaggccgacaaaagctgggagatgttcaccacacgamctccagttttaacaagtgggaggaagtgggtcaggcatgtctcttggtggcaaaagaagt

SEQ ID NO: 2700 - DNA, 121 bp, Gadus morhua
accatacgggacttcaggggaaccggtgttacaagggaggagttaaggggttctacctgamcacgcagacacaccgtcactttatactctctcttttaaagtgtatcctttacacatgagg

SEQ ID NO: 2701 - DNA, 121 bp, Gadus morhua
ttttaatccacggtcctttgtcgaccctgtcttatcactgagtgagacggagtctgttacyctgacgatcatgatggagtccgtcattttgaagtccccgcacacggccagagagtctccc

SEQ ID NO: 2702 - DNA, 121 bp, Gadus morhua
cagcagagctcctcctcctagcaggccttccgttcacatgaacgatggaattacgaaaaakatcgatttttaactagttcacacaactgcaaatctttacaattcgcatttagacacagac

SEQ ID NO: 2703 - DNA, 121 bp, Gadus morhua
aaaaacataataataaaaaaaaattattaaacattttttcgttattacaccaagatttgawtacaagtgtgcatcataggcaatcagtacttttaataaaaaaatgtaaataaacccaaat

SEQ ID NO: 2704 - DNA, 121 bp, Gadus morhua
ctccacatcccgcagactgacgaagctgcactcatcttttctttttcgcatatatctctgrgaagctgcaaagacatcccgagatgatcttgatgtattctcccattgattgctttgagtc

SEQ ID NO: 2705 - DNA, 121 bp, Gadus morhua
agtctgtatcttcagaacaagccctaccaagtctagacgaggtcgagtaacatttgccatrgcatgacatcagcacaaataaaaccataacttagactgcattatgtacaacaagcagcga

SEQ ID NO: 2706 - DNA, 121 bp, Gadus morhua
tcccattccattactgttggggtctgccatgtcagcagagcctaccgtaggctctccgggrttgtatctggttaggaagaaggcctgtctgccttgctggtagcgggacctggaactgaag

SEQ ID NO: 2707 - DNA, 121 bp, Gadus morhua
gtcagcagagcccgacccgtaggcttctcccgggggttggtaattctgggttagagaaagraaggccttgtttggccttggctgggtaagtcggggaacctgggaaactggaagtgggtag

SEQ ID NO: 2708 - DNA, 121 bp, Gadus morhua
tccaaactagagagacagttcttgtgttggagagaacaccttgttattcagaactctggaraagagcagtgtgacgccaaagtcttccttgttaaagggcccaggtcttggccttgtgagg

SEQ ID NO: 2709 - DNA, 121 bp, Gadus morhua
tgcccccatggggcagatcagagtattttgtgcataaaagaaaaatgaaacctttagaaakgtcgcctcccttggtttacttcagccagatgttctttgtttccgacgtcctcattataac

SEQ ID NO: 2710 - DNA, 121 bp, Gadus morhua
gtacgtcttcatgtgccacagtccgtcgttaagataatgaacattttcaattccgatgccyttgctgacttttgtctatgctctctgcagacatcttcatcactccaacacaaagtgcatg

SEQ ID NO: 2711 - DNA, 121 bp, Gadus morhua
cataaccagtgtgatttactcaagtttagactaaacacgttcattgccaatacaaatgatktcgttgtgaccacggaggtgatcgagtccacaaacaaacaggtaaaaatcttgatatgtt

SEQ ID NO: 2712 - DNA, 121 bp, Gadus morhua
tttttacagaaatactgcatacatataaaagcaatgcaatgttatttttttttatcggtcrtaaaggcattttgaatgatctgcgcaatcaatgcaccccacatttggaccatactctccc

SEQ ID NO: 2713 - DNA, 121 bp, Gadus morhua
ttgtttgatttcatccgtggtgttgtacttttgcgatcagttggtggagaccctcccggamctctcctttaatatgatcccttgaagatgtatccggctatagccactccgatctcgacga

SEQ ID NO: 2714 - DNA, 121 bp, Gadus morhua
caatacacaatgttgagattattttggcaaaaaaaaaaaaattattccaaagcttccttarctggcaatacacatgtagaacaagcatgttattaatggccagcctttacattttggaatc

SEQ ID NO: 2715 - DNA, 121 bp, Gadus morhua
cgttattctcaaagtcttccttaggggggaaccgtcacacgtattgtgcaaaaacaaaacwaagaacctgcaacatcaactccgtctgggcgcatttgatacttgtcagcaataaacaaaa

SEQ ID NO: 2716 - DNA, 121 bp, Gadus morhua
ggggtatgactgacccatttccatgccygcaacacaaaactaatctaacaccatggtcttwaattataacagcgacttcgggtttgacgattttgacggtcgactcggcggccttcagcgc

SEQ ID NO: 2717 - DNA, 121 bp, Gadus morhua
tacttttggcaaagttaatgtaaatcaaatgaaaagctaaatgttttgagggtaaaaaaawcacataacaaagaagcagcatagggagagagtagttggacatgatagaagacaagacgta

SEQ ID NO: 2718 - DNA, 121 bp, Gadus morhua
tctgaattgtagcaaatcgtccctgatgccaggatgacatacgtcatgatctctttcagcytcttcaccaacgcagagcttcacaggcctcttggaacaggtcctcggtgcggggtcaggg

SEQ ID NO: 2719 - DNA, 121 bp, Gadus morhua
ggtccggagcaagtattgacaaaagactttatcgtgaagtacaacaacaacgataacagcygggtgggtctgcagagtcacttctcgtcaacagattccagcctcttcttaaacacacaat

SEQ ID NO: 2720 - DNA, 121 bp, Gadus morhua
tactatgtgtttgccacccagtttgtgtggagctccgtcttagcagcggtttaatcagaawgttcgtgtgggtcgtaaccatgggacaccgcgttccccccggaactctcaatcaaaaacc

SEQ ID NO: 2721 - DNA, 121 bp, Gadus morhua
tccaattgttcataggttgaacgtgtgcctactcttcctctgagtcgtggaagaagaagawgatggtagtccagtatctctctttccctccagacgcaatagaggtggtattccactcagc

SEQ ID NO: 2722 - DNA, 121 bp, Gadus morhua
gtaaatcatacaaaagacaatatgtaattcaagaaactgacggcatgtaatcatgatacargaaccatcagcaagagacgacagctggctcctcgtctgggggtcacggctgatgacctct

SEQ ID NO: 2723 - DNA, 121 bp, Gadus morhua
ctgaattgactatgtagtcaaaagactggcacatttccgtgcatgtccatctcggataacrcttgaaaactcctgatagccaagatacatttctcgaatcaaacygttagactctggtact

SEQ ID NO: 2724 - DNA, 121 bp, Gadus morhua
ggtcatcatcttcagcatagcatccctgataaatgggatgtaagacaatccataccaggcraacgccaaaagttgcaaaatgcaaaatagcagcgcaagaccgaaattcttccaccagaag

SEQ ID NO: 2725 - DNA, 121 bp, Gadus morhua
catcaccaactcgttggtcttggctccatgcgcttggtgaatgatcttcagtgtgtcatayccaaacttcttaaagggaggtgggagacctgctctggtggccacatctgttcggacatag

SEQ ID NO: 2726 - DNA, 121 bp, Gadus morhua
tattttaatattgaaccctgccgtccctattccaggctgcagagagagtgtgtgtgtaagktgtagttgtgtgtagtgtgtgcgtgtgtgtgttgtgctgtgcgtgtttgtgtgtgtgctg

SEQ ID NO: 2727 - DNA, 121 bp, Gadus morhua
ggttgtctccatcgagatctccacactatatcgtcattatcaagatgtctgctgtagttcytggatggtgcgtgagaagagcatgaatagcatgcttcttccgtcagttctgagctttgca

SEQ ID NO: 2728 - DNA, 121 bp, Gadus morhua
agccacctggtaggcagctctggctggaaagttggtgctgaagaactgcttgtaaacatcrttgactttggtgaaatcgttcatgtcagccaagagcacagtggtttttacaacattcgca

SEQ ID NO: 2729 - DNA, 121 bp, Gadus morhua
cttcttagtagtcaagtgtatcgtgaattgtgtccaaaattgttttcccaagttggaaaakaaacttattccttgctttaacagtttttcctttaaaaacactcatgtcttagacgtgtga

SEQ ID NO: 2730 - DNA, 121 bp, Gadus morhua
acggagcgatggatcactaatcaaatgttaaaaagctatttgaaactgcaacaaaccccargcaaacatgaaggttcacacacmggaggttaaatttggatgtgtagtgtcactgaaaagc

SEQ ID NO: 2731 - DNA, 121 bp, Gadus morhua
taacagacaataacacatatacttaaaaacataccacagcgtcacttaagccttcgcggtyatgatagtccattcaaaaccacctttttagaaccagaaccactgtataaccctgcacaaa

SEQ ID NO: 2732 - DNA, 121 bp, Gadus morhua
caccagctccccggcagcccaggtcccagcagccagggattcgaccttgacgttttttttyttacactcgtttcttcgttctgtgtcagttccgacgtccgtcgaaaaagtcgaagtttcc

SEQ ID NO: 2733 - DNA, 121 bp, Gadus morhua
ggctcctataggttgctacccgtctcaagtgctcaaaacagagggaactatttctggatayaagtccgctgccactgcgtttgaaactggatgcttgggtttgactatggtctccagtgtg

SEQ ID NO: 2734 - DNA, 121 bp, Gadus morhua
ggatggcatgcacaaatctcgtatggccatttgagatatgtgaatttataaccagcctaawaccaattaggcccattgggacaaaaaattttcacacagtgtctttctaaaaaacgttttg

SEQ ID NO: 2735 - DNA, 121 bp, Gadus morhua
ctaccaacgagaagccaatgtatttgaccttctagggactaaaaaacacatgtttaataartaccccggacttggaaaacaaaactgtggcaaaatttgacctccatcaactaaattattc

SEQ ID NO: 2736 - DNA, 121 bp, Gadus morhua
gtgacatctaacagttagtaataatggttcagaattgttttgctttctatttgaatgttamatggcataacagcatcttcattaagcagttccatcgccaatccatgcccatgtgaattaa

SEQ ID NO: 2737 - DNA, 121 bp, Gadus morhua
ttcagtcgtgcttttttcttccatggagaacattgtgtatctttggtctagatattttttkgattgctcccgtgtgaagatgatgtgagagtacacaagggcttccagcaatactaatgtg

SEQ ID NO: 2738 - DNA, 121 bp, Gadus morhua
tatccatgaaagttgtcatgttgtttatttatacaagacaaaaaacgtttacttgcaaaaraaaatgcagtgccctcttcatggcattaagaacttacatcaggaggatttcaaaatgtaa

SEQ ID NO: 2739 - DNA, 121 bp, Gadus morhua
ggatgcctcagatatgccagcacttggtccaaaatttgaaatctgggtttttgcacttatytccaatgagtacatgtgccttttgaattcccattcccacttgttgaattctgtgcatatt

SEQ ID NO: 2740 - DNA, 121 bp, Gadus morhua
caatgttcatttcagctctcagcttttcctttgggaagggagatatcaacatctggtatckccatctttcccgtcaaatctggtccttccagtttaacattgcctccaggtagatttacct

SEQ ID NO: 2741 - DNA, 121 bp, Gadus morhua
ttgacatttccaaaatgtaattttgctgtattttaaacgttgaaacttgtagataatgaaktcaaggctaaagaacgaagggaaactcagaacattttcattctcaagctagtcctgcaga

SEQ ID NO: 2742 - DNA, 121 bp, Gadus morhua
agaaaaaaaacttttacacacccaacttaatccccttcccttattcctttcccacattcamttaatcctaaatgaagacagcacaaatgtttgcgccaaatcagaaaatacagatcaatcc

SEQ ID NO: 2743 - DNA, 121 bp, Gadus morhua
aaagaatctgttgggcctccacaaaaacaacattgaacacatcatgtcagaccacatgtgyggcagtgaatttattaaaaaaaaaaaaaagatctaaaagtggattggaatgctgagggac

SEQ ID NO: 2744 - DNA, 121 bp, Gadus morhua
aacctctgccagcctgatcatgttataaaccgtgtctcctgtcactttgccaaatatagtrtgtttgttgttgagctcatctgcccgtgccagagtgaagaagaactggctgccgttgtcg

SEQ ID NO: 2745 - DNA, 121 bp, Gadus morhua
ccggcaaaagaaaaaacctcactagatggtaatgaatgaggtttcacatcaaggtcgtacyggcattgcttcacaaaaaacagacwgagtttcccttaagagaactggcatcatcacataa

SEQ ID NO: 2746 - DNA, 121 bp, Gadus morhua
ctttaggaagtagaaagcggttctggccgagcctgatcagcatcaggtttaacatcatgcycctgtttttaaggcttctgatggaggttttctggggtcggcttggaggttgtgcggtcac

SEQ ID NO: 2747 - DNA, 121 bp, Gadus morhua
aaaatgtaaacattaacagtgtaacgtttgagggtaaaaacctttgggattttagttctgkggggtgtattcaaacccagcagagagaccattagaccccatgatgggtccacttccctgt

SEQ ID NO: 2748 - DNA, 121 bp, Gadus morhua
gtgaactccattggtttggattacctatatttacctattttggcgaatgagggcaaaaaamaatggcttctacaaacaagaaagccaatcaacaccagtggtttccaaatattgtggttgc

SEQ ID NO: 2749 - DNA, 121 bp, Gadus morhua
gaagtgacaacatgaaaatgacaaaacattagacagttgtgtctttttaaacttttttttwttacagtctttgacatcctttggcagcctgactcatgatctgctaccagacttgacagct

SEQ ID NO: 2750 - DNA, 121 bp, Gadus morhua
cacactatacacacacacaccgggaagagattggcagaaacaaggataccgttataagtgyatgatctctgtcagtgtctgtgtgggtatccacacttcctgtctgtttttgccacttcct

SEQ ID NO: 2751 - DNA, 121 bp, Gadus morhua
atctataagaagaaagtataaaaccatttgagaacatatacaacggttaagccacccaggsgttttgacaggctaagtttccatagtcacaagactgacccacaattaacaatggcaacga

SEQ ID NO: 2752 - DNA, 121 bp, Gadus morhua
agcctatttcgaagtcatgttgggtgttggggaccaatgaggacaacaatctttgacattkgtccaaaccggatataatgcaatcaactgggccatagcactccccttgggttcgacccgg

SEQ ID NO: 2753 - DNA, 121 bp, Gadus morhua
atgtaaaataaaaaaaaaaatcctattgataaaaaagaaagtagaacaaccattgcacaakgtgtgagggatgctaaccttccaaacgggttatgttaaccctctataatacatatgtaac

SEQ ID NO: 2754 - DNA, 121 bp, Gadus morhua
ttgaacgctttaactttggaaagacgcgcatcataccgttgactacttcaaggtctggcawttttttccatcaccactgttctgcaaacaacatgctcttcatctccaccttccaggtctg

SEQ ID NO: 2755 - DNA, 121 bp, Gadus morhua
tttccccaactagatgtttggctccaaggcaatccgcatttggaaatggctcaattccatrtttatctttcagctctgttaaagttttgggcaatagctcaggattgttgttgttaccggc

SEQ ID NO: 2756 - DNA, 121 bp, Gadus morhua
agtgttaaaaaaacaatcgatgtaaatgtctgctttatgatgtcacccacagaaatgtgtkkttttttttagatgttcagccatatgacattgaatgcaggcttacaagttgtgcactgtc

SEQ ID NO: 2757 - DNA, 121 bp, Gadus morhua
cacttccaacctcaaccctggcattattattgaagttgcgttcttgtagtgcctcttaaasgcacaaggaacgaaggttcaaatcatgttgttttgtttgattactgcagtaatacgaaaa

SEQ ID NO: 2758 - DNA, 121 bp, Gadus morhua
ggttcatcgtgacaaacgtttctcagcagaaaactgcaaattattttgctctcaaatccayctggaaggattgggcatgactgactattacaaaaacacatcaggaataacctattcttca

SEQ ID NO: 2759 - DNA, 121 bp, Gadus morhua
tagttcattattggcaatggtagcaaaatcaccatcggtccaattttgctagtttcaaackaattactcaattgtcgcaaagcaaagaaacactagacactttctatcatattttaccaaa

SEQ ID NO: 2760 - DNA, 121 bp, Gadus morhua
atgccacaatcagccttaccaactcaaggcacacaaatctttacatatgcatggtgatacrcacacagctcacacacacatacactcacgcaaacacaacacacaggaaaaggtttgaagt

SEQ ID NO: 2761 - DNA, 121 bp, Gadus morhua
cattatttaataaacacaatcatttacatccaaagatcagcataaggcaaagagtgtgtcwattcagaatatatccatcacgtcccgctcaggacgtccagtccggcttcagcccgatgtg

SEQ ID NO: 2762 - DNA, 121 bp, Gadus morhua
ccgtctcagtcgagagaaaaatcacacagaaaccgaatctaaacagaacaccgcaaatgtmccgcaaaaatgatatccattaacttttgaaaaattaacaaaaaggtttatttgctgcagt

SEQ ID NO: 2763 - DNA, 121 bp, Gadus morhua
aatgatagccaatccgatgtagtgacacgagtagaagtcctcaacaaaggtgtatcaggayttaatgggggaaagcccataaaacagaaccaaatccagtctattttggaagggacaagac

SEQ ID NO: 2764 - DNA, 121 bp, Gadus morhua
agcagtcaacgctcatggatcttcctcagtgagatttcccttttaacctttttttacacgygagagatgggatttgttgtgtgattaaacagacacattgaaactgaccaatccccagaga

SEQ ID NO: 2765 - DNA, 121 bp, Gadus morhua
ataaactgaccacatatttgaaagaaatcagtatctgacaacaaaaaaaaaaaaaaatcgrtctcatggagcatttctgtccttggaaaatgaggctccattttgcgaatttcaaatgttt

SEQ ID NO: 2766 - DNA, 121 bp, Gadus morhua
ccatctacagggacagtgcattttccgtgagaaagttgcagttccacaatatcttctgaawtaagatgtccaaactgtcaagtagttgacttagtaacttaaatcatccaatttactttcc

SEQ ID NO: 2767 - DNA, 121 bp, Gadus morhua
gtacaaccttctccaactcaccatacacaattcaaaatattatgcactcgtactgaattarcaagcagccatatgaaattgcaacaactcgagacgaatgtggctaaaaaaatattgcact

SEQ ID NO: 2768 - DNA, 121 bp, Gadus morhua
aaaaccttctgaaacgtgacatgcaactgacagaccatagaaacaggaagtaaagaaacarggaagtaaaactgcgcagctttcacgtatgctaagggttagcctgaaagacgtagggtct

SEQ ID NO: 2769 - DNA, 121 bp, Gadus morhua
tggaaaacttctctagctcctcccactcctccwtctcagccaatgacttcagcttcagccmccagtacctcttgtccgacactctgaagtcccggtagaggtggtccgcctgtctctggag

SEQ ID NO: 2770 - DNA, 121 bp, Gadus morhua
atgggagtgatgtaatctattgaacatcaatatccgggcctctgagtggataatagcaccrtggaaaggcttttgaatcccccctagcctgggccaattggcttgtggtgtaaaatgtacc

SEQ ID NO: 2771 - DNA, 121 bp, Gadus morhua
ctccttaacctgaatatctccaatagtttccatcttgccagcagttaacaggtgattcttyacaagaagcgagcactacagtcctctcagccagactttaccgcgggaatataccccccgg

SEQ ID NO: 2772 - DNA, 121 bp, Gadus morhua
actgttggttcatgtcttttgacaacttttgaccccacctggcgttccacacgcccacttycttttggtcgtgctaaaataatacccgccatacacagcaatatcaaagctctcatcttta

SEQ ID NO: 2773 - DNA, 121 bp, Gadus morhua
tataatggggggagcatttcaattgtgttgtgaaaccaaatatggaccgtgagggtggtcwagactcatctcattgtcatacaagaaaggtaattcaccacttcatggcagagctggggct

SEQ ID NO: 2774 - DNA, 121 bp, Gadus morhua
tcgcccgatgaattctttccacctagctccactcattcatgtatgatcaatccattggagrggtgttttagaaggatgggccataacaaaaatccttgattggataaaccacttgtccgcc

SEQ ID NO: 2775 - DNA, 121 bp, Gadus morhua
cccataatggcgaaacccaatagctgtggccatggcgatcttctggaattctttcctgtcyggtttggtacatctctttaccagtcttatggagtcttttacgaactgccgactgggctcc

SEQ ID NO: 2776 - DNA, 121 bp, Gadus morhua
aaacaaatacacacaatttcaacaaatagttaaacattggtccctttttccaagggctacrtcaagtagagtttgatagctccggtcctcactggcaacaattagtgtcgcaggtcttgtc

SEQ ID NO: 2777 - DNA, 121 bp, Gadus morhua
cacgactcacaattccaaaaatagatttatttaagtgtcttagaaattggatcattggttytgcaatgttaccaaaacaccataatcctttcaaaatataacctgggaaaaattgcttcca

SEQ ID NO: 2778 - DNA, 121 bp, Gadus morhua
tatattcccgtagtgttacatagtatgtacaatggaaggctgttcatttggttatatttgragttttcaatgtgcagctacgacagcgcggtagttattgtgccaccttaacgatgtaaaa

SEQ ID NO: 2779 - DNA, 121 bp, Gadus morhua
gacaaaagatcacaacaaaaccaaaacaagatttagagattcaaatccactttacatcccwcgcatgttgtttcatggcttgaactcagcagcccaggaaacgtatgacattagaaacaga

SEQ ID NO: 2780 - DNA, 121 bp, Gadus morhua
aaccagggctttggtctcagtcaacataagaaataacagtatacatgctgtgcaatagaaygccaaaggccggagcttgctgacattcaggtaatggacacgtcgagcccctactaccacg

SEQ ID NO: 2781 - DNA, 121 bp, Gadus morhua
cactgtggtgtttgaaagtggaagcagcttctctgcacagtccccttcagtgactgtatcrcctctcaggaagagctgcccgtgttccaggactgaatccatgggctctactccagttgta

SEQ ID NO: 2782 - DNA, 121 bp, Gadus morhua
attagaccattacacttttattgttcttttgggcttctggttggataagacatctgaaagktgacgacagaaacaaggggtttcatctggttgttagacatcaggcctgctccctcgttca

SEQ ID NO: 2783 - DNA, 121 bp, Gadus morhua
acaatacatacaaagtaggcatcatcggtgggctgggttaaatactgggtactctttttcwgacatattcccaaatcaggacatcattggatattaattattaacatcataaatacatgaa

SEQ ID NO: 2784 - DNA, 121 bp, Gadus morhua
caaaaacaatatgttggcaccatcgagttcacataaaccagccatcggatacaaacaaacwaacaaacacagatgttttctttttcgcaataaaaggtttacagggcaccatctcatggtg

SEQ ID NO: 2785 - DNA, 121 bp, Gadus morhua
ttctaaatgctagcccatgggttagaggaaagatagagcctgtctttcttttatttaccamgacattaaggacctagttgctacggccgccttttaaaccaggggcaagagaccaattcat

SEQ ID NO: 2786 - DNA, 121 bp, Gadus morhua
acacaatgaaagttgcgcaactcaagaaccagcactgtctgtctgattaacagagacccgsccaaatcacatgacagtggtcaccaagatacaaagtacgatagaattcatcacacatgcg

SEQ ID NO: 2787 - DNA, 121 bp, Gadus morhua
actcgtttgtaaatagcgcacaatcctactgttcccaaaaagaaatcccttcctttgaacmccaggaccaatcaaaccttaaagcgcctctcccgtgctgtttccttcagtcagaccaccc

SEQ ID NO: 2788 - DNA, 121 bp, Gadus morhua
gattctttttgatgtcgggtagaaatctttccttcaggacctcccacatttttatcaaacmaatgattacaccattaaaccattaagaacaagcagacacaagagaaataaaaaccaaaga

SEQ ID NO: 2789 - DNA, 121 bp, Gadus morhua
attggctgtggatattcaaccatccaattatccatccacaatttcaaatgcaagttgccayttgccgcattgaatactttataggaagttaagcacatcactcttgataggccacagcaga

SEQ ID NO: 2790 - DNA, 121 bp, Gadus morhua
tatgtcatcagaagggctttaaggacggttaaggctgggaatcaacaggtctggattctgsgcgttaagattgtaatgggcatgaccaagaatagtcctgggaatgtcataacgaaacatg

SEQ ID NO: 2791 - DNA, 121 bp, Gadus morhua
gactccgatgtggttctttggctggtttgctgataaatgtagttggctcgttgcggtgtcsccacatttgctttggaaataagtcgaggtcgacgactcaacaatagccgcagaaaaccag

SEQ ID NO: 2792 - DNA, 121 bp, Gadus morhua
acctctgccaactcttctcttagtagaatatctttctcagtctggttagcaaatatgagakaaccattttgtgtcgtccatatggtctgctgcgatgctgcgaatcagctgcaacattgga

SEQ ID NO: 2793 - DNA, 121 bp, Gadus morhua
cggtcaggaactcctgctcaatagctactgcatccttgatgaaggttgcgaaagccggtcktctcaagaaaggcttgttttaccaggatgtttgaaccatcaaggcaggcgaaagtcgcag

SEQ ID NO: 2794 - DNA, 121 bp, Gadus morhua
agcttagcatcaatggcagccaattccctttttgcttcttccactttcacttgagcaagartatttacttgggcttaagtccaggtagggctccagtttctttgtcaaagggattatttca

SEQ ID NO: 2795 - DNA, 121 bp, Gadus morhua
aagattgtagtggggttccaggcagtctcctattaatctatttatcagttcggcctgctgrgttcctaggttttcctcctgtaggatgggtctgattagggcgtggcaagctgctctggga

SEQ ID NO: 2796 - DNA, 121 bp, Gadus morhua
acaccatacattttcactagggagggtgtttggcaccgcttgtgtgggtagatcgattgargataacagtgagtctgacttgcccctagacatcaggcggctgtgtgcgttgcgccaaaaa

SEQ ID NO: 2797 - DNA, 121 bp, Gadus morhua
tacatataaaaagtaaagggttgaagtcaatctaaagccatctcctttgtcagtcaggctyacattgataagcgatgggttaaaacactcacaggactaaaattatatggtaaaaagaaac

SEQ ID NO: 2798 - DNA, 121 bp, Gadus morhua
cacttagcagaccctgaaaggtgttgatattgtctggataacttactgaaacaatgaaagscccctcacccaccacatgtacctcagtattcaagtcacgattacaggtcagagctgggaa

SEQ ID NO: 2799 - DNA, 121 bp, Gadus morhua
accgcatggttttcctttagaccacttaacagtacatgtttttcccgtataaaatcagttmgtttccaactgcaggagcagaaatgatatttgattgagcccacatgagattttggccaaa

SEQ ID NO: 2800 - DNA, 121 bp, Gadus morhua
gccgctggcaaattggatctttccatccgcttcctgctcttcaaacaccatgacctgattkgttcctttgtgaagccagggcccagggaggtagagggtttgctgtggaccaatggagcag

SEQ ID NO: 2801 - DNA, 121 bp, Gadus morhua
gtcaatagtgactcagaaacagagacgggttcgatcacagaaagccagaaaaataaaagtwgtaggcttaaggggaacaaatacgcatgttggcttataggtcgagagtatgtggcacaaa

SEQ ID NO: 2802 - DNA, 121 bp, Gadus morhua
ttaggtttgatgcattttatctaaaccaataagcttagctattaaagcaggaggggagttmttgaagtccaagacataagttgggtcttcgctaaccggatctaggttggcatgagccatg

SEQ ID NO: 2803 - DNA, 121 bp, Gadus morhua
ggggtttttattaarwcaataagtactttgactcacccaacactgacaacatcacacatgraaacactgacatcacgcacccggcagaacgattgacatctgacatccaggcacacacagg

SEQ ID NO: 2804 - DNA, 121 bp, Gadus morhua
caacgtgaaacgatgggaaaggggcacagtggcaaattgctgatttgtacactgtgtggayatacatgcataatgacgatgttggccctttcgtatgcacgcaagcttaacagtaaagggc

SEQ ID NO: 2805 - DNA, 121 bp, Gadus morhua
ccgtttaacacaccaatgggccaataaaatttttattcctggttggccttaaaataatttsggtcgaaatatagtcttctcaaagctgggccaaatgactggacaacaaatacagaagctg

SEQ ID NO: 2806 - DNA, 121 bp, Gadus morhua
aacgcgagcggagagcccattgcaaagacacggcctgggacctaaagctttgtgtgtgttytcaaaagacaaaagtcgaaaaattaactacagaaaaagaaaaggcctcgaggtctgcccg

SEQ ID NO: 2807 - DNA, 121 bp, Gadus morhua
gatcatctcaggggctgtaaagctccctggacatgtgcgatacttgtctctgtaagcctcmaactcgcttccacagtttgcaaygttgaataagggtatgtggatcacagtgggggctttc

SEQ ID NO: 2808 - DNA, 121 bp, Gadus morhua
caaatatgctttcatacatcttcaaaaaatcttaaaatacaactacacccatgtctacagytttgaaaaagtcagccattgtccaataaaaaccattatcctttctgcacaagccaaaagt

SEQ ID NO: 2809 - DNA, 121 bp, Gadus morhua
cttcctatttacatagtcatccgatttatcagtatattatcagtaccgaaaagcgaggcascgtgagggcctaatggtttaatcttaacggttaatttagaataaagtttcggaattgaga

SEQ ID NO: 2810 - DNA, 121 bp, Gadus morhua
ttaacaggaggagtgggccaggggttataccctagtctttgattctttttttgcatttcaycctaatacttcatccaggccaaaaaacgatcaattccatgatccttgttacctgacaggg

SEQ ID NO: 2811 - DNA, 121 bp, Gadus morhua
aacacgactgaataaaaggtaattcccaagtcatccccagaatctggtgaaacccaggttyaatatccggtacaacaaaaacagcgatctcccagtgtccgaaatacacagaagtggactc

SEQ ID NO: 2812 - DNA, 121 bp, Gadus morhua
aagttcaactgaagctggtgtctttaataccctttgaaatgagcacctacaaattgagaawataaaaaggcctatatagggacattatacaatacctgctacaatagtatcctactgatag

SEQ ID NO: 2813 - DNA, 121 bp, Gadus morhua
aaaattattttggtctctagcctgctatgttcaccatttgtttccactaatcaacccccckaaaacgtactttgtatgaggcgacatagcgtcactgaaagacaaataccgaccggagatg

SEQ ID NO: 2814 - DNA, 121 bp, Gadus morhua
tattatttcatattaaaaaggatgtttctgacaaacaaacagttccttatggaacacaagkgacggtaaaagtgcacatcaatcctttgagatctctatttacacaatcagtcgattctgg

SEQ ID NO: 2815 - DNA, 121 bp, Gadus morhua
tacagggtcccattcatttggtgtctcccatcaaagatactaacgtgtccgaacaacgacmaaaatcacacgttgttacgtgtattaataaaatggtaaatattttaaaccaaaatacccg

SEQ ID NO: 2816 - DNA, 121 bp, Gadus morhua
actgcagatgactgctttacacatgcagcgaaaacaatgtgcacagaagcgttcaaatgtwcaaacaagaaaacaaagaccccaaaaacatttatatacmcctatwaacaagtaagcaaac

SEQ ID NO: 2817 - DNA, 121 bp, Gadus morhua
gacaatatgagtcttcagccacaaaaccaatccagaccgagaaatccattgctatacccasaatgagggattgacaacgacagaactgacagattggattttacacatatatacatacata

SEQ ID NO: 2818 - DNA, 121 bp, Gadus morhua
gtgatactgagatcagccacggaatgctgccaaaggaggagcttcctcccaggaaaaatgracataaaggtgaactgcagaaagaacatttagtgaaggcttttccaatagaaccatactg

SEQ ID NO: 2819 - DNA, 121 bp, Gadus morhua
caaagccaccactaatactttttaacttactaacatttcaacggtcatgtattttggcctrcagacaaaaaacaccaaaagataataaaattcacatttaaactgccttaaaaacccatta

SEQ ID NO: 2820 - DNA, 121 bp, Gadus morhua
ttctccttcccgggtccgggtcttcttttccacgccagtgaatcttaagggccaaacccgraaaggacaaatgtaaagcgaaaaccagcacatggcattgacgcaagctcaaatacatttt

SEQ ID NO: 2821 - DNA, 121 bp, Gadus morhua
gggagcagtgtgtgtgacatcatcaaccccggcttcctggaagccaacatactaccgtacwcacacacacacacacacacttgaagccatgacgtcatggaaacacacacgaggccctgcc

SEQ ID NO: 2822 - DNA, 121 bp, Gadus morhua
accacactacttcctcccaaggtggggctccactctgagttacaagaagggaacttctagrctctcggcctgcaactgagacttcagcctctgaccctcgaaaagtaattcctccaacttc

SEQ ID NO: 2823 - DNA, 121 bp, Gadus morhua
ccaaggataattaccctttccatttggtcgttaaaaaacaccaacagcatccaaatactcmtgggacagggaagcggtaaaaggcagaacgataaatgggactgacttgtttcgatgtcta

SEQ ID NO: 2824 - DNA, 121 bp, Gadus morhua
tttcaagcacttttcttctatttkgtaaataagaataaaaagattttgtctgggactgttraaaatgcctaggtggtgtgtgtgtagtgagtctgtagaaaagtgggttcttactgcttgt

SEQ ID NO: 2825 - DNA, 121 bp, Gadus morhua
gggtaactccgctgcatagtgggggatgttgcgtctcatcaggggctcggttccatgtttyatgctatgacttaataaagaagtctgtcgtgagtgtcttcccctcacttgtttgccgatt

SEQ ID NO: 2826 - DNA, 121 bp, Gadus morhua
agccatgctctagcccagaagggccagcaacaagtaaagtttaagaggatggatgtttccygtggaaagggaatcatgcatagtcatggcctaaaggaacagggcaaaacagaggaattct

SEQ ID NO: 2827 - DNA, 121 bp, Gadus morhua
tggggggggaagtatttgaacgaacaagctcaattaaagccacactccccattgtttgtckggtgtgaggcagttttgtaaagttacaaaacggttaatactcgtacactggcagcccacg

SEQ ID NO: 2828 - DNA, 121 bp, Gadus morhua
ctcttccatttctttttgctgaatttccaagttagttgtctgattttgtgcatccagaatmttctgctctatgaattgcatcttcattgtaatgtcttgatgtgtcttttcaaccaactct

SEQ ID NO: 2829 - DNA, 121 bp, Gadus morhua
ttggttcctaatatcgtttttcattgacacgtgttgttgggctactttctacctgtggcayaagcctttccccacaataagagcttagcgtatgaagctcactcccggtaccatcactgat

SEQ ID NO: 2830 - DNA, 121 bp, Gadus morhua
cctgataacacggtcctctatggctctgggtgtctgaggagggttcaaaactgagagaccrcagccccagaccctccagttggactttttgatgaagattctgcccaactaccaccactta

SEQ ID NO: 2831 - DNA, 121 bp, Gadus morhua
gaaggcgtatcttgggaccgtgttggtgttggggatcagcgttgccacgcagtggtcgacraacacgcgcagtggcacgtgatggaactgagccactgacgcctcgatgttgagctggtct

SEQ ID NO: 2832 - DNA, 121 bp, Gadus morhua
attggcggtaaatatatctatatacaaataagccccatatacacaagtggtgtccacgccsmctttgaactcagggagattaaagtgagtggatagagggacagagagagagaagttaaca

SEQ ID NO: 2833 - DNA, 121 bp, Gadus morhua
tgtacatcagcagaacttctgctcctttcgtcacacaatttctccttcaacgggggattcmgtttccaacacatccacctatatacagtttctctatgttcaacataaccttaaacatagc

SEQ ID NO: 2834 - DNA, 121 bp, Gadus morhua
gtcggatgggattggggtcacatcctcaatacggccgatcttcatcccagagcgagccagrgccctctttatcggaccgagcgccaggggccgggggtcttggtcctgtttcctccrgtgg

SEQ ID NO: 2835 - DNA, 121 bp, Gadus morhua
atattaattgcagttttatagcgctattcaagatacccaaagcgctttactgtgtgtgtgwgtgtgtgtgtgtgtgtgggggggggcactaaatgtatttccattccttatgaacagcaga

SEQ ID NO: 2836 - DNA, 121 bp, Gadus morhua
ttggaacatcaattggcagattcggagtttgcggttcaatagatcatcagtgaaacatygytggcgacaacaattgaaccctccagctaagcacctctagtaatgtagcaacctataaaaa

SEQ ID NO: 2837 - DNA, 121 bp, Gadus morhua
ttagtaagcctaaaagaaatacacataaaacagtgtgcatgaaacatgcttaatgtatctratgtaattattattcctattatttatcttcaacatttcgggctctacaggggacaagaat

SEQ ID NO: 2838 - DNA, 121 bp, Gadus morhua
gagacactgctgggcgtacgtgaggatgctctctgcttatcaaggctgggcccttccgctraatctcctttgttgaggtctggtggatgrttaatggagtggtcactcttcatggagacac

SEQ ID NO: 2839 - DNA, 121 bp, Gadus morhua
gctgacgcccagtggcgaattaaggaactgcattatggtgaggtcatctcccccttggttrttttacacatactgggaggaggaaaatccactaggattggaaaacaatgctaatkcactc

SEQ ID NO: 2840 - DNA, 121 bp, Gadus morhua
agaacaacagcacacagggtcatcgggcttcagaagttgacccaaaaaaaaacaaacgtckggacaagcagacccctccaatcctctggaacaaaccaacccaccacccaccmctcctgtg

SEQ ID NO: 2841 - DNA, 121 bp, Gadus morhua
ttctggggcatccaatcaacgatcagtgtgttgttgcccaaagaagatggtatttttccartgtgcctccaaatgaccttttgaggcatctttgcaaagaccctggcaatatcctctgtga

SEQ ID NO: 2842 - DNA, 121 bp, Gadus morhua
ctgggggtggggggtagtgtataaaagataggagagaggagaagggaaagaggagacgtamacctattgtgtggacgagtgaccatgacagaagtaaaaagagagtgaagtactttgctat

SEQ ID NO: 2843 - DNA, 121 bp, Gadus morhua
tccagacatggcgatcactacattctgagacactgatgatcctgttatggactgaattaayctcttgatggcggccttggggaaggccgagcgtctgtacatctcatatcggttcaggctg

SEQ ID NO: 2844 - DNA, 121 bp, Gadus morhua
tatgttgtttgtttgacacctaacaggagtacaaagaataataataacgtcaaagtgtatratggaacattttatcagagtctttgattgggaatgagatacaaaggaggtcccgggggac

SEQ ID NO: 2845 - DNA, 121 bp, Gadus morhua
ttccctcatggaccaaaatagctaacatacaaatcacttctctcaatgcttaagagacgcwggcctatcagttagtaacacaaccatacggtaacagaaataccatagcatgtgcaaactg

SEQ ID NO: 2846 - DNA, 121 bp, Gadus morhua
gggttcgacagtgaatatgccatttttaattaattgtgcagtattttagttgcacaacacmctttgaattccttttgaaaacctcacaataaatgcttgacagacatgggaagatcattta

SEQ ID NO: 2847 - DNA, 121 bp, Gadus morhua
actgtaaacacatggagccatggtagcaagtggcaagttctatgacatacacaccaacatktgtggttgtgcctctgcatgacgagcttcacattggaacagccattaccaccacgcctga

SEQ ID NO: 2848 - DNA, 121 bp, Gadus morhua
cgtactcaccatctgtttggaggtctccaaataaggcagtaaaacagtaataacagcaccmccacagtaagaacgccatgagaactcagcagattttatgagaggcttctccgaggctaaa

SEQ ID NO: 2849 - DNA, 121 bp, Gadus morhua
aactgacaaactgggattaaaatacctaactaaccaccttgatcatttagtcaaattctargcattagaaccccatatgctggcattaatgcttttcaagttgaagaataacatcattcaa

SEQ ID NO: 2850 - DNA, 121 bp, Gadus morhua
cttcaccgcttgcatatttcacaaatgtgccatatagaatggcgagaccggcttccatggsagttggatcttgcatatttctggatgatcggtggagctgtgtgtggatgggttgtctgga

SEQ ID NO: 2851 - DNA, 121 bp, Gadus morhua
tcaccatggggacccggcagggagggaaggacctggttctcggaacacaaaggtctggacscgagtgaagacccgtgaggaagactagcagcatcgctcacgtactaggagtccaggcccc

SEQ ID NO: 2852 - DNA, 121 bp, Gadus morhua
aaaagaacgttaattcaaatccgtcagcaccaaagtttctgcaggcattagtggcaacgtwatgggagtgatgtaatctattgaacatcaatatccgggcctctgagtggataatagcacc

SEQ ID NO: 2853 - DNA, 121 bp, Gadus morhua
aaccctgtcgaaaccattaagatgcatgaaaacctaagttaggcctcaatcctaatatttsctctctgttaatcttcgagtcagcctctacagctgtagtaaagttttccataaaagagcg

SEQ ID NO: 2854 - DNA, 121 bp, Gadus morhua
atagccctttcttgcagccgaaatccaaagttggcaaatccttgaacttttattttaacrwgagtcttggcgaatcgttgatgaaagccaatcagtttaagcgtgcgtgtgcttacgttgc

SEQ ID NO: 2855 - DNA, 121 bp, Gadus morhua
aaagaattaatgtttttagggacaaaatatattctctataaagaaaaacaggacaatttgyagttttgcacttgggttcccagttccgtgaaggtgaccgttgccggggttcttcattcaa

SEQ ID NO: 2856 - DNA, 121 bp, Gadus morhua
taggcagaatcttcctacgtaaatcctcagaatgttatagttggcagattggcacgacatkaccgaatgggcatatcaacaagccggatacatttggtggtgctttatgaaacatwaaaca

SEQ ID NO: 2857 - DNA, 121 bp, Gadus morhua
cttctccggggttgaatgaggagtacttgggcatccaaaaggtggtcagaaccatatttcragtcctctgtggcaccccatccagaaatagtgcactctgagccgtccggcattgtgacat

SEQ ID NO: 2858 - DNA, 121 bp, Gadus morhua
cctctgagatgtcccaggtgaagttcagctgcaggtccttcattctttcgttgtagactckgtcgaagcgctcactctgtgccactgtcagggcgttcttccagtcaccgatggtcccttt

SEQ ID NO: 2859 - DNA, 121 bp, Gadus morhua
accccagctcgtgtgtctggtccagacacacaagctatacattcagggcaaagggtatcawcttataatatgattcatctggtgtcgtccggaaagcaagagacagacgttctctagaagc

SEQ ID NO: 2860 - DNA, 121 bp, Gadus morhua
ttttccaaatagcrgccactagtggctggagttgtagttataacttgtctgggaattaagmtgggttccctgggttggattgacccatgggatgggaatgtttgattmttgggaaactttg

SEQ ID NO: 2861 - DNA, 121 bp, Gadus morhua
ttaacaacgatgaagagacagagcaaactttgacaaatgtgcatttgtgaaacacaaatamctgttacttattggcatccctcgtgtaaaagcatcataaacttgtagttatttcccttat

SEQ ID NO: 2862 - DNA, 121 bp, Gadus morhua
accttatgattgagactgccttgaggagagaagatctgatttgcagactctgtgatttgtscgttgttacgaaacattccactaggggggggcacttgttacccaacacataattgaggat

SEQ ID NO: 2863 - DNA, 121 bp, Gadus morhua
tacaggtccagaaggtaacattcaagtttgggttacatgaatcttgcaactgagttaactmtaaagatggaaatgaatgccatcatcagcagcccttacatgttcataacaaacatctcag

SEQ ID NO: 2864 - DNA, 121 bp, Gadus morhua
cccaatcatttccaaaggaacacatagcatgaagagatgttattacgattgatgtgaatamgctgtaaaacctggactacaggrcaatgtaaacagaaggaagtgggaactaaatgggatg

SEQ ID NO: 2865 - DNA, 121 bp, Gadus morhua
acacgcaggaccaaaaaaccacaatgacagcacgaggcaacaaaggaaagacaagggcttragtaacaaacgcaacggaggaacagctgagacacattaggggagggagcacgtaatcaac

SEQ ID NO: 2866 - DNA, 121 bp, Gadus morhua
ccctcccttcccaaaaagggtccaaccaaacagcttcagcaggatgaacacgactgttgcyttggttcccatgaggaaataaatgtgccattaagttttagtcacatttctccctcccacg

SEQ ID NO: 2867 - DNA, 121 bp, Gadus morhua
attggaacacaatgatcagaggcttcagatttgatctgcacacatatttatacctcatttmaattatttacaaccacagaaatgttaaktccatggcgctacggccccagcaaagcctata

SEQ ID NO: 2868 - DNA, 121 bp, Gadus morhua
attctaaatgcattattagttcccaaaagaattgatgacaaaatggagatggtctaaaaayagacaacgattgtaattaactttctttaaacatgacatggtgctgccagctgcccagtgg

SEQ ID NO: 2869 - DNA, 121 bp, Gadus morhua
taaaggactttccttctaraagctaagcaatcctgtgaaatccctatactagcatccaaamcttcccaatggaatttccaggtttgacgcaatattttcccgacattgcgattaaattatt

SEQ ID NO: 2870 - DNA, 121 bp, Gadus morhua
atacccctcacttgtaacatacagtttaacacatctttctgatcactctttacttcatttyaatccctgtccccatataatgggatacaacccatgtatgaacttctaaagataaaggaaa

SEQ ID NO: 2871 - DNA, 121 bp, Gadus morhua
tctagaatctattagaacacaccatggggtaattagcactgtttcaaggacaatatcttakaaaaattaaaccttggaaaagaaacgaatcactaaagccaattctgtccaagtttggacg

SEQ ID NO: 2872 - DNA, 121 bp, Gadus morhua
ataaaaagctagattgagtgcgatcggtcacatgacataagcttaaaccatacaaacctakttgctggcaccgacttttttagaaagtggaaaatgattaccaagcatttgagccaaaaga

SEQ ID NO: 2873 - DNA, 121 bp, Gadus morhua
tctcttgtaaaaaaaaccccagttataaatgaacctaaaaaccaaaaggtaaacataaaakaaaattacagtatttcagggggagatccaccgatacttgattgaacactaacaaagtact

SEQ ID NO: 2874 - DNA, 121 bp, Gadus morhua
tatttccatcttttgattcgtaaatcctgaataaagkatcgctaccatctataccgaactygcgctgttggtcgaggagcatcttcaccacatcgtcgcgaatgtcttggcgcgtcacaac

SEQ ID NO: 2875 - DNA, 121 bp, Gadus morhua
taagcaaagttatgaagggcaattaaaattactttccaatatgtcataacaattccaattraagttaatacccatgtttatggtgactacttaaatatttgaaggtcaagattattcaaat

SEQ ID NO: 2876 - DNA, 121 bp, Gadus morhua
cttcaatacgatagaattccaaatcaatgcaatgcaattaaactccactgcatccagaawwatatgtgcacgttgaaaaaagcaacacaaatgtctcccctaaacaaatgaatagtaaaat

SEQ ID NO: 2877 - DNA, 121 bp, Gadus morhua
atagggcaccaagttggtctggaactctgtcagatcaacgttaagagcaccatcaaaacgragggaagcaagtaatggaggaccacaatctgactgatcagcctgttgaggttggtatagg

SEQ ID NO: 2878 - DNA, 121 bp, Gadus morhua
tttaccaggttccgcttcgctttccctggttgaaaccggatgattacacgcccatgtggcycagcggattagcagaccttgtttctcatctccttcgtaaaaagagtttcggctccttcgg

SEQ ID NO: 2879 - DNA, 121 bp, Gadus morhua
cacagtaacaaaacacgcaataaaaaaaataaaaacggtatttgtgtagtgctgtgtcccygcaccctgagtacatggatataggccacttatgttaagaatggggaacataggcaccaaa

SEQ ID NO: 2880 - DNA, 121 bp, Gadus morhua
cggccggttcctttgatgacacacagtaaacaaaacaccgcaataaaaaaaaaataaaaayggtatttgtgtagtgctgtgtccccgcacctgagtacatggatataggccacttatgtta

SEQ ID NO: 2881 - DNA, 121 bp, Gadus morhua
aaaaagcagattcattcttttttttcatacagtcaattgagtagaaggcaccaaaacaatktgtgcaatttatccgagcagagatccttgaattgtacaaacttgtgtgtgcccttcgtgc

SEQ ID NO: 2882 - DNA, 121 bp, Gadus morhua
acagcgattagcactgcaaatacaacaacaagcaggactatgatgactatcactgcaatckccccaggtgatagaggacctgggtggttgggttggtttgggtggtttgagtgggttgaga

SEQ ID NO: 2883 - DNA, 121 bp, Gadus morhua
gataaattataggggaggacacagggggataaaatgattgcgtgatttgtgtgcaattaamtgattttacactgcgaaataactcttctggaaaaggataagtattgcacataatggctca

SEQ ID NO: 2884 - DNA, 121 bp, Gadus morhua
ctgtgggctatgagatatttatacattcagagatcaaaaacaagaaaaatcaaaacaccgstgagacttagaagccagactaaaattaaacaccaaaagtgtctctgtgttaggagctcag

SEQ ID NO: 2885 - DNA, 121 bp, Gadus morhua
cttctgttggtcatctgtgacgacaggctctctcgctggcgccccctggcctctcttttgrattttgactacgatcttggtcttctcgtttttgccgatgtaggtcctgtagtttcttctc

SEQ ID NO: 2886 - DNA, 121 bp, Gadus morhua
gtaagcagatgagtggaaattgtattaataaacaatgatccaaagaggcatttgatccctraaaaaaaatggaatgggacgtgcggtggaaaatcacagttttgttttttccaacaacaaa

SEQ ID NO: 2887 - DNA, 121 bp, Gadus morhua
agcatttacacggtcatttgcaagctgaaggatctttctcagtgcagatagaatcagcatrtccatgtcatcattcaattcgatttctccatgggtagtccttcaggggaaagrtgcagtt

SEQ ID NO: 2888 - DNA, 121 bp, Gadus morhua
atagttgattgccttgttttttaactccattaattcaagcaggaaaacctcgtggaattakgctcccagcatcttggttccctggaatgtagtaagtcctgttgagcttctcgttctgaaa

SEQ ID NO: 2889 - DNA, 121 bp, Gadus morhua
taccttgctcctgcatcagcatgacctctgtgctctttgttggtaaagcgtagctttccgmcaccctgacgccgagccggttgcagaggttgtggatgtaccgggagtagtgctccaccac

SEQ ID NO: 2890 - DNA, 121 bp, Gadus morhua
gcactttagctgaggttacctggtatcacttcgctttaacatgtgtatctgttattaacakggaagaatcataccggtttgatcattgctggatcacaatagatttgaataggcacgaata

SEQ ID NO: 2891 - DNA, 121 bp, Gadus morhua
tggaacctcgttgtccatctttatctggctgaactcaaggaggtcttcctgtaccacgaaraaccgaccttttgtgtctttggtttcttcatccttgaagcgctggtagagtttgcgtgtg

SEQ ID NO: 2892 - DNA, 121 bp, Gadus morhua
gaaaataaacaacagtgttttgggttcaaaccgcctaaacgccttcgaattcatgccctaraagggcattccccttgagtgctagcgctgcacatagacttagcagttatgcaaacagtat

SEQ ID NO: 2893 - DNA, 121 bp, Gadus morhua
ctccgcttcatggagaaccttgataggcacgccgatagacatgttgtcggtcctggtttamgtatttggaagagttttctttgttwtttgggatagtcttctacactgcggcaacgtaccc

SEQ ID NO: 2894 - DNA, 121 bp, Gadus morhua
tatttggtaacaatctgcaaagtatgtctacatatctaattcattcgattgataaattctmgaagacatccaaactgaaatcactacatatttcagcctccaactggaaaaaacattgagt

SEQ ID NO: 2895 - DNA, 121 bp, Gadus morhua
gtggtgaccttctgttttggtggaactcaaggcaatccgaaacatctccaccgtctcctckgacctatggaagggcgacacattcttccctccaaccagcaggccggcggtgtggcccgtc

SEQ ID NO: 2896 - DNA, 121 bp, Gadus morhua
aggtaactactccctactaatgttgtgttatagtgcaaaaaggaggccggacctgctatgkttcccttgggtgagtagaaggagtgtccggggaagggggtgaaatctacttagtttagta

SEQ ID NO: 2897 - DNA, 121 bp, Gadus morhua
ggacatccatttaaaatgtgattgtcttcatcacttgccttgacaatgctattttagtagrtagtgctttttccccaacaaagccgtcctttgattcatcgcagtgcaagcagttgatttt

SEQ ID NO: 2898 - DNA, 121 bp, Gadus morhua
ggccccatgatggagctgggaaatcaaaatctctccaatagtctgggaacttcttgaaaakaacgagaagtcgagggttaaggtaaagatgaggctgaagttatggtctcgttaggctgat

SEQ ID NO: 2899 - DNA, 121 bp, Gadus morhua
cgagggctgactttggtttacttgaaacttgtaataataaacaatatgactatcaggaatmagggccattattcttgatcgccttgacagacgtttggtaagcaacccagtgaagaatttt

SEQ ID NO: 2900 - DNA, 121 bp, Gadus morhua
atgttttattattatttttacaaaaaaataagttttaatgagcgtcaactacttaatagtwttctggtacaactctgccaaacaacaactcagcacattaacacattcgttttcaaagatt

SEQ ID NO: 2901 - DNA, 121 bp, Gadus morhua
cagagcagagcaatacaaatgtctgtcattcttttgctcatctcatttgtaaacaatgatkgcaagtacggtcataaacaatgccaaaaatgctttgaaatatttagaggaaacccaaatt

SEQ ID NO: 2902 - DNA, 121 bp, Gadus morhua
gaggttgaccagggcaaactcctggtagttcctcagcacatcggcgtcgatgtcgtcgtaracccccatgctctctgaattggccacggtctcgttggagaagacaggcctgttctcggcc

SEQ ID NO: 2903 - DNA, 121 bp, Gadus morhua
cagtcatatgtaattgtcggaagcataatggctagaatataacacgtgtactgtatctctygtaatgagacacaaagttcgaacttctattcatcattttccttacaacacacgtttgaac

SEQ ID NO: 2904 - DNA, 121 bp, Gadus morhua
tgtagttgcccggtggatctgaagtgcagctcgctgccattcaggcatgtgatcttcactstggccgagtaggggaggtcaatgactgctcgtcccactgtcgcctcaactgtcatggtct

SEQ ID NO: 2905 - DNA, 121 bp, Gadus morhua
taaaaaatttaagcccgtccaaaggccaaatgttcttggaagggggtcgtgggatcatttkttttcggatttggaaaaaattgttcccaaacggggtgggcccccgattggcccccggttc

SEQ ID NO: 2906 - DNA, 121 bp, Gadus morhua
ccgcttgaaattggaccatataaaccccacaggtgttgagcaaatatttgatttgattgcmaagaacaccaaaccatagaaattcaaaacactactttaaatgcattctgttcacgggttg

SEQ ID NO: 2907 - DNA, 121 bp, Gadus morhua
cagatacctttcactgttaaatttctcaacactgggatttattcacacaaataagcccggsactagcacaaacatttgaacctggcaaaaaacacaaatattcacccatcaggctatactt

SEQ ID NO: 2908 - DNA, 121 bp, Gadus morhua
ttcataaattaatattaatcagtgagattgaaatcaacatttatccaacagtatttaaaawgcagcttatgtccatttatctaattaaatgaatggattggatgcctacttctaccttact

SEQ ID NO: 2909 - DNA, 121 bp, Gadus morhua
agtgtgccacattagttcttgtagagagggcagcaggtgattacactcaaggctcaaaagkcctttaacccaagggttgagtatgtttacacatgcttacatgctgtatgggctttgagtg

SEQ ID NO: 2910 - DNA, 121 bp, Gadus morhua
gtttgaattgccaaagagaactttttggacctcccgcccacagataacaaagtggcaaaawaaaaaaaaaaaagaaactctacagcaaggctcccaaaccaaagaaaatcttgcattgcag

SEQ ID NO: 2911 - DNA, 121 bp, Gadus morhua
ccgctgcacgtctcaaccctgttggtacagcctcttctgagacaccggttgcacctcagarcttctccaaagctgaaggccaatgcaagcaccagaacaaccggtaaagtcttcatctttc

SEQ ID NO: 2912 - DNA, 121 bp, Gadus morhua
cccagctgcactcagtacatcttggatctcagaacaggaaggattttctactgccttctckgccgcgattcgtcgcccctctgcgagcgtcttcttactgtccaggtagactggatacaca

SEQ ID NO: 2913 - DNA, 121 bp, Gadus morhua
ccctatatgttttcaatggaaacactcaatcaggagtcagatatgtaaccagggttttgcyaggaccaaaagcgaaatatcggaaaatgacatgttgcgtcgcacgaatcgcgtggacctc

SEQ ID NO: 2914 - DNA, 121 bp, Gadus morhua
acgtgggatggttttcgggttgtgggtttttccccwaggaggagaaaagaggcaagcgacwttccccggggggggacggggaaagggcacctcttccagaattagcagggcctgatgtaag

SEQ ID NO: 2915 - DNA, 121 bp, Gadus morhua
ggactcgtcttctcgatgatagccttggcttgatccactgagacgtggcagggggctgtcmtccggggcaaatggtcgtgttcatgcagttgagttcccctgggttttggcctgctgagag

SEQ ID NO: 2916 - DNA, 121 bp, Gadus morhua
aattaaagattttcatttgtatatatccatagaatttatatgaaacttgttccattaaccrawtgataaaatcccatgctatatccaaagggcaaaaaatgttgagagggagggtgacata

SEQ ID NO: 2917 - DNA, 121 bp, Gadus morhua
tgactggcaggatcccaaactgatactggtgactgatgtttgagtgaagccaggatagagytacaaaggttagacccccagactgttcttgacctttaagttatttttttggcactcttgt

SEQ ID NO: 2918 - DNA, 121 bp, Gadus morhua
cacattactgtattgagatcaaaaatcttgctttgtagttggaatgaatacttttacacawttttgkctaactttggttacacctctttctcagacatattccaaataaaacaacaaaact

SEQ ID NO: 2919 - DNA, 121 bp, Gadus morhua
ttttacaacggtatgaagtgcatytcgacccaagctacttgtcgaaatgcattcataccgytgyaaaattaggctgcatatttcatgttccaatgacaagttagcaggaaattaactacac

SEQ ID NO: 2920 - DNA, 121 bp, Gadus morhua
aatttatttagaacagggatgtttggctattcgtggatcagcgggcctacgagggctgctycgagccgccggcatctgcctcgtaccaggagagggttttcaaagtgtcgcaaataaagct

SEQ ID NO: 2921 - DNA, 121 bp, Gadus morhua
aggaatgctaaacgtgtagaagggattcaccgcgccagcgatgctgtaaaacgtggccgtkccctcatcacaatccaccagcacgcctacgcgcttcgaactgaggctcgccagcaccgtc

SEQ ID NO: 2922 - DNA, 121 bp, Gadus morhua
ggccaggttggtcaggctaccagcatgtgaaattaggccgagctcccaccacttctccgaycaaggcggctagagttgggggccacctggctcatcctggagcgcaagttactcctgcagc

SEQ ID NO: 2923 - DNA, 121 bp, Gadus morhua
gctgtcgtcgtaggctatggggtcggggcagtcctccgggtccctcagcgtgtcaaagtamggatagctccagggccagytcgggcagtgggcctctcgtccccgtccagaaccagcatct

SEQ ID NO: 2924 - DNA, 121 bp, Gadus morhua
aagttgccacctgcttaaaccgcataaaaataggattaagcgttggatatcgttaaaggsktaaggtctgctgcatcctgttacgtggatttaacaaacatgcaacctttagttgaataaa

SEQ ID NO: 2925 - DNA, 121 bp, Gadus morhua
tccctactcaacgccagtacgaataggaatgggaaaattacccaaatgtcgcaccaaacayaacatttaaatttcccaaggaactaagtcccaccaatttatgcacttttttcttccccat

SEQ ID NO: 2926 - DNA, 121 bp, Gadus morhua
ttctcccgggtcagcgtcgcgatcttccactttctcggcggacagcttgctgacgtccatkgtcttgtttgaggactttgacagcgagggccagcgctgaggccagagacatctcgccctc

SEQ ID NO: 2927 - DNA, 121 bp, Gadus morhua
gtcgtgaggcagacaacaagtttaaagaatttgctctatgattgaatccacagaagacacyaagagggatgggttcggtgactcgtatcaatgtcttccggagacaagtgagagaagacta

SEQ ID NO: 2928 - DNA, 121 bp, Gadus morhua
ctctccacatcgccgaacaacaacgtcaccagtgttacaaacgttcaaaaacaaaaacaamaaaaaacacaaaacccgaaaaacaaacacacacgatggaaacatctgaatcactcgtttc

SEQ ID NO: 2929 - DNA, 121 bp, Gadus morhua
aagtaagtcacgtttgagagtgtcatgacggtcggatgacctcatggtgtggcccccaatygtggacgacatgtgtggcatgtggccaggagacaattgtcatgctttcgtctagttttat

SEQ ID NO: 2930 - DNA, 121 bp, Gadus morhua
atgactaatgctatgatgctaatgtgaagcacatgaactcaacgggcgtcttggccacgcyccacaaccaccagtactatgtcaacagagtgccccagtcggtgcgctcagccctgaagca

SEQ ID NO: 2931 - DNA, 121 bp, Gadus morhua
ggggaaatggggaacagtgaacaagcagtccaagacacttgttttgaactgtggtaccccrtaaccacagtcatgcacaacaaggcgtcctcttaagaacttgttcatcctctactccaca

SEQ ID NO: 2932 - DNA, 121 bp, Gadus morhua
cgacaaactaaacaaaatggctgtttaaatcaaatgacagtgccattttatcaatcaatcmaatagcacagttttgaagaatcagcaaagcaaaatatgtgacacttttaaagtgcttatc

SEQ ID NO: 2933 - DNA, 121 bp, Gadus morhua
gtacctcatgcacaccgaccaccagacgaagcagagatgaagaaagaaacgcgtgattcamgcataaaatcgggaaagcgcttccaactccagttgacatcatagtgagtatatgaagcag

SEQ ID NO: 2934 - DNA, 121 bp, Gadus morhua
aataaaacggaagtcaaatctgtgtagttacaagtacatgctgwacatattttcacatctkaaaaccgaggtccttttcccccccctcccagaaaagaggtacaaatgtagcgtaatttga

SEQ ID NO: 2935 - DNA, 121 bp, Gadus morhua
ccattgacaggaaatacatgtttttaatagttagtctttaaaagtacatggaatagcttgkkgttttctgtcgataaaaatactcraatgattcctgaaagcttgtttggatagtgtgcaa

SEQ ID NO: 2936 - DNA, 121 bp, Gadus morhua
cgttattctatgataattagccacagtccccatattactatgccttaaactgtttcggatyaactgaaagcaagttcaaccaggtagcagtctttggaaatgtaggattatttaacaaaat

SEQ ID NO: 2937 - DNA, 121 bp, Gadus morhua
aaataccatagcatgtgcaaactggctaccaaactaaacacacttccaaacgggaggattkggacaggggggggtggggcgtagggagggttatgttcgctaattactcgagacctagaag

SEQ ID NO: 2938 - DNA, 121 bp, Gadus morhua
gcccgggataagtatgtatgccggtaggcagaagtcatatccttaagagtctctcagcggscgccaggtgaaacaggaagttctctgtggggggagggaagtgatgttacttcaagccttc

SEQ ID NO: 2939 - DNA, 121 bp, Gadus morhua
tcaaccaaagggaaaaaacaacatcttgcaactggtttggaagggcacacggtgcacagcytccygccagagggcctcatgtgccttacgcttggagctgcaagttcaatgtggatcatga

SEQ ID NO: 2940 - DNA, 121 bp, Gadus morhua
agacacaaatgagagacacaaaataggtatttaggatttcagtagggggggggggggggcmttacttttgttgcaacccaaaacaaagtgtacttctgttctcccctgcaagtcggttttt

SEQ ID NO: 2941 - DNA, 121 bp, Gadus morhua
aaaagttaaacatgggtaacatgcaattttttttaacttgatctcaaatgaatagaaatcrgctcatgagcaagcaatctatatctacctaactcaaaactctacatatggtgccatggta

SEQ ID NO: 2942 - DNA, 121 bp, Gadus morhua
tattattggaayaaattaatcaaggggctcaataacaaaacatttgaggttttaaaaaaawawatatatatattgctcctctatgcaccaggtataagatattcaaaatatacacaacata

SEQ ID NO: 2943 - DNA, 121 bp, Gadus morhua
gtagtgaggcaaactaacagtacaaatacaaatgtgatccctttgaacccctaattttttwattaggatgaccactcaaacaacttcaaaatggatgggcaagactcaagcattgaggggt

SEQ ID NO: 2944 - DNA, 121 bp, Gadus morhua
ctccttcttcatcttcttctcccatgctgtcagtgccaacctcttcataatccttctccaraacggccatgtcttctcttgcctctgaggacactccttcctccatkccctccccaacata

SEQ ID NO: 2945 - DNA, 121 bp, Gadus morhua
aaaattgacatcggaggatgttacagagaggtgacagttctactaaataagccaaatatgraaaaagaaaagaaaagaaaaaaacggtatttgtcccagctcaaaaaaataataaatgcaa

SEQ ID NO: 2946 - DNA, 121 bp, Gadus morhua
gaacgtaccccagcactccagaccctccctcctcgagaaccctccagaacctctgaataaygtgacacactagtgtcactagggatctggttaattaggggatgcactttgtttaattctg

SEQ ID NO: 2947 - DNA, 121 bp, Gadus morhua
aaaatatcacatttatctgtcacaatttaacaatacctaaaagcggccctctccaattttstccctcagccacttaatctccttagtgatccaaaatgtcctcttgataaagtgcacctgt

SEQ ID NO: 2948 - DNA, 121 bp, Gadus morhua
gaactccactagtttggcctggttcttcagcagtatgtccaacacgggctgtgctcttgtwaggggttcgcaaccgaagaccttaaagacgtgaaaggcttcaaactggatattgcggcta

SEQ ID NO: 2949 - DNA, 121 bp, Gadus morhua
cagacaagaggtacacacgcacacggagcatgcccagtttaggagtgcatagttacttggsggagtcccccctgggtcccgggtaaccacgggggccaaaaaaagtgatgtcacgccctct

SEQ ID NO: 2950 - DNA, 121 bp, Gadus morhua
cgtccacgaggaacgtgtggttctcgaaaggtttaggccaagtggagcctgtctccatacrgcggtgaggtttgcatcgaagatgaatgcattttccgtaccactctgtctgcaaactcca

SEQ ID NO: 2951 - DNA, 121 bp, Gadus morhua
cgtaaggccccctgagaggggatcttacaatgaagatgtgtaatttattttccgacatttygccgttgtcggccgttgtcgactaggcaaaaatagaataaagaaataataaaatgatacc

SEQ ID NO: 2952 - DNA, 121 bp, Gadus morhua
tccaagatgcttcaggggatggaagttgatctgttggtatatgggggttgggaacatgttycaggtctcaggtgagtagcattcagtccctgtgctgaggtcggtgtatagccgcatgtct

SEQ ID NO: 2953 - DNA, 121 bp, Gadus morhua
attgtacttaagcattttaccgtaacccccccgaattaccccctttgctacactgcaaaartattgctgatcttggccaattgtatacaccctttacaatgctatacatccgacagctgag

SEQ ID NO: 2954 - DNA, 121 bp, Gadus morhua
agacgaacatccaatgtaactttggaacacaaactattccaaatgtatgtttggtggaaargaagagttccgccgattagcggactgttctggaccatgtaactcttagtttgttggccgt

SEQ ID NO: 2955 - DNA, 121 bp, Gadus morhua
atagacaaaggccatgttcagtggcattgtaccctgtgtacattccaacttcgagagtttkgttgactttaaatgagttttcatgaggattgccccatggaactggggcctgttctgtggc

SEQ ID NO: 2956 - DNA, 121 bp, Gadus morhua
gcctgccactcattacatgtaagggaaaagtctgaagaatgaagaaaataccatgatagtractgttatggtatcttatactggtcattaagaactgtttagctctgttgccacattttaa

SEQ ID NO: 2957 - DNA, 121 bp, Gadus morhua
tctacagggccgagagccgcacagccccccagctctcacgggacccttggtccatccagcrgggggcagtgccacagacggctaaaggctattggattactggtaaaaaactaaatgtata

SEQ ID NO: 2958 - DNA, 121 bp, Gadus morhua
aactgatccaaaaccttcacgtattttgctaggctcgtccgttttgtaaatctctaatccytctttctctccgctgcatctatatcactgtccttctccttaggcacctgctcttcctcct

SEQ ID NO: 2959 - DNA, 121 bp, Gadus morhua
gaaacctcgctggatgaaatgctgtgcccactgcgccttgtctgctccgatcttctggatsacatacaggattctgaaagaggctggatcccaaaggcaatgatgtcacatatcatccgca

SEQ ID NO: 2960 - DNA, 121 bp, Gadus morhua
tgtacatgatggtgtaggatgctatgcatacgacatattggaggcatttttcttaggatarggaatgtcagagatcggacaaacataacatcaaataactcatgtatgatacccgaaaaat

SEQ ID NO: 2961 - DNA, 121 bp, Gadus morhua
taaggcctggacgctactctaaacactttgttgtcctcagaacctcggctccagccagcgrcatggagagccacacccctgcgctccacgcaatactttayacacacccttcctttgccag

SEQ ID NO: 2962 - DNA, 121 bp, Gadus morhua
tgaatcttatattacataacaaaatctcacatgatcccwtcacacataataataattaatwgttcattatatgtatttagcgcttttcaatgacccaaagacgcttacaatgaaggggggg

SEQ ID NO: 2963 - DNA, 121 bp, Gadus morhua
ttgaatgctatcttgtgttcagctatagaatacgtatgtttttttttaaagtggtgctccrcttcwttgtgactatacaaataaggacaaaacacaaaacaaggaaaacgcattgacactt

SEQ ID NO: 2964 - DNA, 121 bp, Gadus morhua
tctgattgttctctccgttgatggactccgattttcttacccgctctttttcttctttttygtctgtggggaacctcctcctcctccccctcttcttcttcttcatccgcctgcctacgaa

SEQ ID NO: 2965 - DNA, 121 bp, Gadus morhua
tcaacacatctgttttgaatatacatgaccctagtttaggcagtctatcttttgtcttctmaagttcaagaaccaggtccaaagcttccagccttctctgccacctctaatgcgatcttca

SEQ ID NO: 2966 - DNA, 121 bp, Gadus morhua
ggtacatgagctgcaaccaagcactattagttatcgattgcggttcctgcaaatttcaagmacacactctaaatatggtttatatactgaaataattcacatggaatgttgtcatttgtat

SEQ ID NO: 2967 - DNA, 121 bp, Gadus morhua
attatagcactttaacttcagattcctaggggagtctgattgacgaaacatcattatgacmtttagagtttcctgtgctcaagtgtttttcaccatattacgttatcaatgtctatgaaac

SEQ ID NO: 2968 - DNA, 121 bp, Gadus morhua
aggatcagagtagtacttccaaatcagagagatcatgagggccgcctgtaaaatataaaayagtatgttcacaacccatttcattttagcctgttgtgcagttcttgatttcacatgcgtc

SEQ ID NO: 2969 - DNA, 121 bp, Gadus morhua
cttcaaattatatattagagaagctgaccccaatagcaatgtatcacatgcgtaattaatytagaatattaacgttttgggatacaagcatggggcaataggtcatacaagtagcctataa

SEQ ID NO: 2970 - DNA, 121 bp, Gadus morhua
atggttgagctccgtagccccgcgacgcagcgctatcatgcccgcctccacgcacacagcyttgtgcctgggctccgttgaagtcgtcggtgcagcgggccagctcctcgtagttgacgtc

SEQ ID NO: 2971 - DNA, 121 bp, Gadus morhua
aaacaatattttctgagaatattacttgtaataaatgaaataatgacccagaaaatgaacytttgctctttacagttgcaggtaaggcgaatgataagattttgtctcattaagggtttgc

SEQ ID NO: 2972 - DNA, 121 bp, Gadus morhua
ctaactgagcttgacggggaatacaataattgacttaatatataatttgattgaatctacrctcatttaatttgctattggccatataaaaccttttgaaataatacaataataagaagat

SEQ ID NO: 2973 - DNA, 121 bp, Gadus morhua
gttacagttggttgttagaaaaagcaaataacactttaatttgaaataaacagcattccayttaaattaaaccctagcacaaagaaaataaaatcaagtaatgcacattgggctttaattt

SEQ ID NO: 2974 - DNA, 121 bp, Gadus morhua
ataaataacggaaagattaaaaaaagaacatttttcaacctctgaagaaagaaaaaaaaawagaatgcagtgctgatttcatcccactttttttggctacttaattgcttggtcttcaaga

SEQ ID NO: 2975 - DNA, 121 bp, Gadus morhua
atgaatttacaattcatgtgcctcgtggcaaaaatggaatgtataccacagaaatcatcamagtaaacgttatatcagcctttctgcaaaaggcggagggactcagggcgtgctgaggaca

SEQ ID NO: 2976 - DNA, 121 bp, Gadus morhua
ttccgtacatacataggagctctgtggtcacatcactttatctctcaacgattgagatccytgaaggccatggatgcaagttctttatacacatacacgcatacaaaggcaaatgacaacc

SEQ ID NO: 2977 - DNA, 121 bp, Gadus morhua
agagaggatcatcacaagcctcatgaagatgttcaatgtgtccatgtagatccccatacaygcgttgatggggtcgaatttctgaacaccgtacagcgggtatgtctctgccttcttgatg

SEQ ID NO: 2978 - DNA, 121 bp, Gadus morhua
ggagacttcacccatgttcctcctgtccctgggtcggccccgtgcgcttggatcaagtagwagggcacggctgccttgctcgcaggagaaaactcaaacacaaagcccacaggtaccctgg

SEQ ID NO: 2979 - DNA, 121 bp, Gadus morhua
gcttctcgatctccgtcttggacagcctgcttggccttcccgatggcacacgccccagtarccgtatagcgatccctgaggggtccaccatgtaagagctgagggccgtcgtccacatcgt

SEQ ID NO: 2980 - DNA, 121 bp, Gadus morhua
ggcagtatacacatggaaaacacagtatcactatgaagcaatgcaccatttaaaaaaaacytccaacaataagcagctggtgccctttaaacgtctttcttcatttcctccatcaacaaca

SEQ ID NO: 2981 - DNA, 121 bp, Gadus morhua
ccgggggtcttcatgtatctggctggacttcatgtaagcagaaatcttctccagagcctcraagtggtccaatagatctcggaggttcttgaatatcatgccaggcacttgggctcaaaca

SEQ ID NO: 2982 - DNA, 121 bp, Gadus morhua
ttttgacttttgaacagactttattctttaataagcaatacatgggagcttgcttaaaacmaattmaaccttttaaaatccattaagtatccgtkggaagttcttggaagagaaccgaaag

SEQ ID NO: 2983 - DNA, 121 bp, Gadus morhua
taaaggctaccgaaggcaaaacatgaatccctgtgattacgatgtgcaggtccaaggaatwacattatggccggaraggttgtgctgagatgaacacaatgtgaatcaaacacaatcagct

SEQ ID NO: 2984 - DNA, 121 bp, Gadus morhua
tcaaggtaccacttgaaacggtttacaattcagcctttttcttagttcttttctctcagayacatccccaaggtcaatatcgtgatcctcaaagggcaggattccaggccagattgacgtt

SEQ ID NO: 2985 - DNA, 121 bp, Gadus morhua
acactgtacttccagcccttaaaggggacaagccgtttcgaaaatcacytagtgggygcgyccatccagatctgtgctggayaggatgagcaatgtttacttcaggtccactgggtgggcg

SEQ ID NO: 2986 - DNA, 121 bp, Gadus morhua
gaatggggattcatttattktktgtttcaacagaaacagaagactgaataacatccttttwytwaaccgaacattgatgcagaacgattgaamagrttaatttttttacttgaatttgcaa

SEQ ID NO: 2987 - DNA, 121 bp, Gadus morhua
atgtcggttagcaccagacgacttgaatggcattgatgaacgaggaatcccatwacagtcsatgtctgagccagcattcccctcggaaccccaggcagactccagaacccacatcgatgcg

SEQ ID NO: 2988 - DNA, 121 bp, Gadus morhua
gatttcccttagctattccaagtgtcagcagaacttactgtactagtgaaaccaggatatmttcttctcttgattgaacagtccaagcataatcagtccacgaatcaaattaaccattaaa

SEQ ID NO: 2989 - DNA, 121 bp, Gadus morhua
tataacgaataaagtgaggcaaaacatacacaaaactcagcaaaccaaaagaggcaaatgrcacaatctaacaaggggaggcccgacaatgtttatttcatataacaatcgttaattgtaa

SEQ ID NO: 2990 - DNA, 121 bp, Gadus morhua
gaacgtaaagcattgattaaccacaggggttacacatttcataagtataactatttgtggyatatatatatatctccgattaagatttgagtggtccagagaatcatggttctagatgtga

SEQ ID NO: 2991 - DNA, 121 bp, Gadus morhua
gacaaacaggaaaacaaagagacctccttcaatgccatgagatgccctttcaggcaaaatwaaattaggcagaatcttcctacgtaaatcctcagaatgttatagttggcagattggcacg

SEQ ID NO: 2992 - DNA, 121 bp, Gadus morhua
caataatccatatatattgggtatgctattctcataaggaaaactcagacagaaataagcktagtaatgaaggttaataacataaacattgaatgcccttaatgttcttgtgtcaaactca

SEQ ID NO: 2993 - DNA, 121 bp, Gadus morhua
ggtataaaactgtcaaatgtaacatgttctcaatattaatttgctcacattcccatatgtycattttcttgggaataaatattactatcaataataaaataaaagttaaaataatatatgt

SEQ ID NO: 2994 - DNA, 121 bp, Gadus morhua
tttccataactaatgggccttcttcaggaagtcagtcccgccggtggtgtctcccttttcmgtgtcctgaagcacgggcactagcaatcggatgtattcggaggccgccttgagtgtgtcc

SEQ ID NO: 2995 - DNA, 121 bp, Gadus morhua
ctcaacaaagggacaaaaagttcctcctggtgggatcacagtccttgaggccatcatcgcstacaaacttcgtcattgcacgacggcatctgtccctcctgtgcgttggtggacacaccca

SEQ ID NO: 2996 - DNA, 121 bp, Gadus morhua
aactggacactggtggtcatttaatgtgataatagcatttagtccctcaaattaaatacaygattagcggggattggcaagatttgatatggagttaactaacacgccccctagtggaata

SEQ ID NO: 2997 - DNA, 121 bp, Gadus morhua
tcggtttcttggatargattggaatacaccagggtaacgtgcaatgcataacgcagaaaakaccattgcgatctgctgcatccatctctcaaaccgcgactatcagagagagagggcgaag

SEQ ID NO: 2998 - DNA, 121 bp, Gadus morhua
gggaaaataacacaagacttccttttctgggcccggtctctttcaaagaggcaatggtgaycaaattatcttataatactgattatttacacctttgcatcagcttcctgtccttcaatgc

SEQ ID NO: 2999 - DNA, 121 bp, Gadus morhua
aaaatataaaagtgacattaccgttacatgctgattggctgtttaaatcctaaaaaacaawacatgttgatgttgatgctccagaaagcaatccaacgatcacagagcagccaggccagac

SEQ ID NO: 3000 - DNA, 121 bp, Gadus morhua
tactatccttcagttttgttcaaatgaaaggtccattaaaaaaaaatggaaacaaatatgrctataattaagccatggaagtcagccaaaactttacggcacacttgaaaacattttaatt

SEQ ID NO: 3001 - DNA, 121 bp, Gadus morhua
gaaagatttgcttagtttctaattaaaatgtcactactgtaggccgtggatggcatgcatktcctaccatttacaacaagacattagtatactgacatggytttctmcaagttaaggtcac

SEQ ID NO: 3002 - DNA, 121 bp, Gadus morhua
agagctgtgggtggtgaaaagaggttttagacagggtccaggtcctgttgctgagcaagawgggaggctttttttgtacctttccaggtatttgtgtcgcaactcccaactgcctccatgc

SEQ ID NO: 3003 - DNA, 121 bp, Gadus morhua
aatcagtacgtatttgactcatccaagccacattatcgtcaccctcttagggtaatggccyaagtcatatcttcaagttgttcacgaaaacagaaaaaactgaaccatatatagagtatat

SEQ ID NO: 3004 - DNA, 121 bp, Gadus morhua
gtaaagagagattgaagatgtgttctaagcacgtgcgagagtgtcctcctagctgatcctraccacaaacccacgtatgtctaatcgctgccgagagagctctaaagttttttgtggccag

SEQ ID NO: 3005 - DNA, 121 bp, Gadus morhua
gaagcatcgttcagagcgcagattccgatcacttccacgagggccagagaacgactaaccrgcggttgccggttttcaggctctcctcgttgccacctttgccaagatcgtcagccttctc

SEQ ID NO: 3006 - DNA, 121 bp, Gadus morhua
ccgaactcttggatggtgatctctttgtcaaggtactgctgaagttgccggtttgtgatgygtcccatgcggagcgcatcatcaattgagaacttctgccctgatttcctgtcgtgaagaa

SEQ ID NO: 3007 - DNA, 121 bp, Gadus morhua
aagctcgcttagagggttagcgaggtatgttgagctccaagcctgggttagttgtaccacraaagtcgatctcttttagcgtcgatgtatcaccatggtgacttatgctcgcaaccaaacc

SEQ ID NO: 3008 - DNA, 121 bp, Gadus morhua
cggagatgttgttatcaggctccaaactgaactgtttccagaaggtttttgtgagcgttgygttgtccacccatctccagtccccctccagctctctgtctgataggccgatccagaagta

SEQ ID NO: 3009 - DNA, 121 bp, Gadus morhua
aggctgttccatacctgaaaaacacatgggtgacatgttaatcgtttcctttattacaacmattttttttccctccccaagagtcccaccataacgcaaaacaggggctactcgaggaaac

SEQ ID NO: 3010 - DNA, 121 bp, Gadus morhua
ccatgtgcagtgcccaaagttgggcataggtgatgacttgctgaccgctggtgataagttrttaaacatgggaatgtcggattagttaagtgtttctccgctataataataaggggcgaac

SEQ ID NO: 3011 - DNA, 121 bp, Gadus morhua
agcagtcacaaatgtcatgttaatctatgctgcaatacatcttcgagtttcggaaatactyggaaaaacagttaaacattaaccatattttcagtggcaattcaagcccctttttttccca

SEQ ID NO: 3012 - DNA, 121 bp, Gadus morhua
catggttgtgttttcccttttgcgccatagttcggctgaaacatctaattccgatatgttyaaacgttaactttgtatgttcatccgttaaaaaaaaatgacatcacatcaaaacactggg

SEQ ID NO: 3013 - DNA, 121 bp, Gadus morhua
atcacaaaaattaactatcaaagtctaatcgagtcgtagtggccggaggaaatggttgaawtacacactaaaaaggtagttatcagaacagtccagtgggacgatgttctccatcagaaca

SEQ ID NO: 3014 - DNA, 121 bp, Gadus morhua
tagcggcagcctatgccaacactaaatgcaagtaaatggcgactgaaataactctctgtaraccgtgggacggtgggtttttcagataccgcagagttcagtatttttctaagtaccatct

SEQ ID NO: 3015 - DNA, 121 bp, Gadus morhua
tgaaattaaaccaaaattaggggaaatcaaacttttgaattttttaacctggttaacgttraaaccataaaaaacataacctgttacccaaaaaatgcatcactttttgaataaaataatg

SEQ ID NO: 3016 - DNA, 121 bp, Gadus morhua
aaccgtgctttctgtttttaataacagaacactaaggaaaaaaggagaaaaacactgaccratcaaatcaaaataagtttgggttaactcgtttctgacaggacaggtaaacgccgacgtt

SEQ ID NO: 3017 - DNA, 121 bp, Gadus morhua
aacacatgaggatttttatgaaagcacatggaaatcattaaagaacacagattatgcaacrtctgcaatgcaatggacttttatacttaatggcaacagtgacaaaccaaatatttacaat

SEQ ID NO: 3018 - DNA, 121 bp, Gadus morhua
taaaaagaggtcagttaaaaaaaaaagagagtcaatttccattgatgagtaaaaaaaaawwagaatgagaaaaaaagagttggttcctaatatcgtttttcattgacacgtgttgttgggc

SEQ ID NO: 3019 - DNA, 121 bp, Gadus morhua
ttgggacctggttgtaaagaggaggatgccttgagcatacactgatcgaaacagtggcctytattgatagagaaataatccttccatccaattaaactgcaagcccctcacagaacatact

SEQ ID NO: 3020 - DNA, 121 bp, Gadus morhua
cctcaggcaggcccatttcctctaagaagctatgctaccgctgtctggagaccacagattragtctatctacgagtttgaccttccttttggctagacattgtttgaccatcattaataac

SEQ ID NO: 3021 - DNA, 121 bp, Gadus morhua
gagcgagtgcaatgacataaagacacacacagccaagcactcacatgagccactaaagcgwacggttgacgccccaaagcactgctctaaggttaatcactatacaagctagaaaaacaca

SEQ ID NO: 3022 - DNA, 121 bp, Gadus morhua
gagcagagagttctgaatgcttttgtacacctggttgtagatctcctccttggttttcttrccatcaagatactctatggaattgcagtagttttccatctctttcctggtgtttcacgta

SEQ ID NO: 3023 - DNA, 121 bp, Gadus morhua
aaatctccagtacacatttgaccacaccttcttccattgttacaggacaaatctcagtttmaccttcaaaccaccaaatcccagttgctttttgctttaccatttctcatgtttttttttt

SEQ ID NO: 3024 - DNA, 121 bp, Gadus morhua
ccgggcaatatgtagagctcactgtcaaaaacctgccatgtgtcttttcacagccatgttyaatgtacagttcgagaacaaagatttgtgaggatgagccacatgttcctaggtaactttt

SEQ ID NO: 3025 - DNA, 121 bp, Gadus morhua
cacattcctagcaacagacacataaaacactacatataaccacaatatcagtattgtgatygagtgattgtgtttccaggctgatgaccaaaagacaacaaaagcttattacatgaataga

SEQ ID NO: 3026 - DNA, 121 bp, Gadus morhua
tttcttggtttcgttttttagtttcacaaaacccttctccctcctcttccacatggtggaytgaggacctaagcggttctatactttattgcttaaaaaccagcaacctgttcccgagaat

SEQ ID NO: 3027 - DNA, 121 bp, Gadus morhua
cgttttaatcattacagaaagacgggagcattgtagaaatgattaggaccagttgacggcmaatgtattgttaccattgtcaatgtaacatgggtaaacattagaaaatacaaagcaatta

SEQ ID NO: 3028 - DNA, 121 bp, Gadus morhua
catgggattctcgagtaaagagatgmagtgatatactgtgcactgtaatattaggtcmatraatatgcagcggaaaggacacacacacacaagaaactctgccttgacgtctctcgtattt

SEQ ID NO: 3029 - DNA, 121 bp, Gadus morhua
gtcatatgtctgccgttcctttcacttgtcggccgactggatacggtatgagtgtgccgtwaatggatgatcacactgaaatgaacttgttcttctttccttttcctgcattttggcccca

SEQ ID NO: 3030 - DNA, 121 bp, Gadus morhua
ttttcttcatacataatcctgtgtgtaggacttcccacctttcccaaaggttccataaacmgccatcatcaattcaatggaaactactttctgattactacttccttacaggccacctatt

SEQ ID NO: 3031 - DNA, 121 bp, Gadus morhua
aaaattaaaccaacttttatttaatactttgaaatgttaacgaaccattattgaagaaaamaaccagaaccccgggtcccacttttttcttccgtttccttttcttccacttctccttcca

SEQ ID NO: 3032 - DNA, 121 bp, Gadus morhua
atctaccacctgtttctccaccactttggggtccatgtcmgggacaaggcggatggagaaytttccratgactttcctgggaataaccgtcttggccccctccatcggagaacgccccctc

SEQ ID NO: 3033 - DNA, 121 bp, Gadus morhua
aatgaggatttatatacattcaattatttattaccaccaaaggattgggattaaaaaaaamtagaacttgaaaatccacagacatacatcattgccttgtgtagggaacttgcttattgtc

SEQ ID NO: 3034 - DNA, 121 bp, Gadus morhua
tcccctttactctttgtctccataagcagtgctcgtttgtgagtgagatatccactgtttkccggacagtttcaactttctgatgtggggggttccaagagtaatctctttattaaccttc

SEQ ID NO: 3035 - DNA, 121 bp, Gadus morhua
ccgactcaccgtctcgttgactttacgcaccgccgtgttgagctgctcgtacgtaaaccgscccttcatgtactgagggatgttttcaaactccaggcattgtaacaaactccattttgtt

SEQ ID NO: 3036 - DNA, 121 bp, Gadus morhua
aacttttgagtcaacggtgctcacagtcaatgtgactcattattgtatagctgggggtgtwtgtttgcgtaaattgcgctcataaaattaatatttcccccagtggtcatcaccagacgca

SEQ ID NO: 3037 - DNA, 121 bp, Gadus morhua
aacaacaagccaaccatgcttggcgtctgcgttggccatcccaaaaatgcttgtttttkkkgtaaatggaccctgcccatgtttctcttgactatttactgacggggttgagaacatgcca

SEQ ID NO: 3038 - DNA, 121 bp, Gadus morhua
tcctcaaaaccacattgagcatcccatatgaagcaaaacaaaatcacatgaaagaaggaaygaatgccatttgccacaaataatctaaacttgtaattcgaaatctgccaaatttcatatt

SEQ ID NO: 3039 - DNA, 121 bp, Gadus morhua
atcgtcaaaatcaaagatccggaaggcgtagtgggacttgatctccagggtggccgagtcrctgaagagcactcagaaggtccaggaagtcctcaaaggtcagaccgtcccttgactccga

SEQ ID NO: 3040 - DNA, 121 bp, Gadus morhua
cggaccgtggccaactcctttctgtttccccagcatttatccacgcgaagctgcttgtagktctttcccaggaggctgagctccaggttgatgtggttgaactccctgcggagtgtgcccc

SEQ ID NO: 3041 - DNA, 121 bp, Gadus morhua
aaaggattagcacctatccctatgttttttacttctttgctttcccctgggcagccaccgsctccatggccttcctcacagtctctttgtctcccaggaactgcatgggcttcacaggctt

SEQ ID NO: 3042 - DNA, 121 bp, Gadus morhua
aaaaaggtacacattttcatttggctttgtgtgcaatgcattgggattctgtatgtgcatmtgtatgcgtatgtgtgtatgcatgtattgtgtgtaaattactgcgaacaatacagcaaac

SEQ ID NO: 3043 - DNA, 121 bp, Gadus morhua
atttgaataaaatgttaaaagtattataactaaaacaaatacagcacgtttcaattatttmaatcctcaaattaaacccaatgcttttatgtgaaaaataaaatgtcattttgacattttg

SEQ ID NO: 3044 - DNA, 121 bp, Gadus morhua
tacgcagggctgtggaccgcttagaaaaactttggtgtggcggagacacagagagatgaarcacatggctaacatgttggctaaaatacaccgatccacaatgacatgctataaacacatg

SEQ ID NO: 3045 - DNA, 121 bp, Gadus morhua
cacttgttacactcaacataacccacacacaggcaaggccaaaacaacttaaatgtggaayagatgtactaacaactgtcttgggaggaggtgtggctctgtggggggtaatctaaggctg

SEQ ID NO: 3046 - DNA, 121 bp, Gadus morhua
gtaggggaggtcaatgactgctcgtcccactgtcgcctcaactgtcatggtctttcctgcmgggaccgttactttgacctcatctgattcggttatggtctcagaggaggtcattgaggtg

SEQ ID NO: 3047 - DNA, 121 bp, Gadus morhua
aaagtttgtccaaagaacccttaacatgaagcctgaccacccacctaccacaaagctcccygttacaaattaaaccctgctgaacgatggcgtaatgatagtgcacatggatccctgccgt

SEQ ID NO: 3048 - DNA, 121 bp, Gadus morhua
tgaggtactggckggcccaactcaagcttctctctgcactgaagcctgtcggcaaaacacyctcctgctgtgggcggctaccctggtgtccttacttgacttgaggggcctcactacattt

SEQ ID NO: 3049 - DNA, 121 bp, Gadus morhua
ttgtgtcaatgcgtgtgtgaatgacccatgtagtagactgtgagtaaacccttagtgtctkttgcccaaagacagtctgctctttccttggagctgaaccgagtctctggtggcggaggct

SEQ ID NO: 3050 - DNA, 121 bp, Gadus morhua
cacttacaatgacataaatttcataacatcggattgaaatgactctagttagctgtgacamtcataaataatttggaacatcacattttaaaagtgatatagatcaccataataaatcaaa

SEQ ID NO: 3051 - DNA, 121 bp, Gadus morhua
tatatttatatgtatgtacatttccccttgcattggcatgctacaaaggtcgtgaccttamagttctaaagaaaaaacagttaaaacaagattggataaaagacgttttactattctccca

SEQ ID NO: 3052 - DNA, 121 bp, Gadus morhua
ttactatcgaaacgaggatattggtaagtgcccctttcccaaaacaagtgcagcgaaaaawaataaaaaaaaaaataaaaaaacacaccagcagggacttggactatctaagcacaggtcc

SEQ ID NO: 3053 - DNA, 121 bp, Gadus morhua
agctggggtcatttggatggggccatgccaagtgatcagatgtcaggatccaaatgacccyaatttgaaggaagggcttcgtagtacacgatatggtggccatgcatactaccggtgcaaa

SEQ ID NO: 3054 - DNA, 121 bp, Gadus morhua
ccgttcatcacctgcctgaactcctcgtgagtcatatctccaaagtgattcatccccagcytgtatgagtgcttgccaatggagtgctccaggttgtgaatttcaattttcttcaagttct

SEQ ID NO: 3055 - DNA, 121 bp, Gadus morhua
gtggggtactgcagcaaatatgatgagccctgggtgatgaagaaggtcaggcagcttaagrggacaaaaagggcagcattggcctcccccccctccctcctgaagctcatcacctccagct

SEQ ID NO: 3056 - DNA, 121 bp, Gadus morhua
atcctatggcacagtcacaaataagccgagattctactctcccgtgcagaaaacaatcctytatgttgtcgggccaatcgtcttcttcatattggtcatcatcttggtgcgcaacgaaagg

SEQ ID NO: 3057 - DNA, 121 bp, Gadus morhua
gcatcatcaccaggtccaggctgctcagcctagacatcttggagattgacttaaagcttgsccgctggtacgttctggagaccaactacgaccactggaaggctcctctgttcctggacga

SEQ ID NO: 3058 - DNA, 121 bp, Gadus morhua
actcacacttctgaaggaagcaggtatggagaagatcaacttctctggcggagagccgttyctgcatgagaagggagacttcctgggacggttggtccagttctgcaaagtggacctacag

SEQ ID NO: 3059 - DNA, 121 bp, Gadus morhua
ccatcaagtttttttgggatgtattccacaatctacctttggaaaagaagaaacagttttyattatttctcacgggaagtgaccgcatacccattctggggatgaagagcctgaagctggt

SEQ ID NO: 3060 - DNA, 121 bp, Gadus morhua
cgaaaataaattcagaaaggatatcctctacagaaaagtatcccgagacttggaccattgrccagttgggtcgggtcacgtctttacactagaggccacagcatatgctcttctagctctg

SEQ ID NO: 3061 - DNA, 121 bp, Gadus morhua
agtgtgtatcggagccaattgtcaaccaagatgttccaggaagaagagagatgctggcaargctacccagcggtacgttgagaacactgccatggttagcagcatggaggtccagttcgtc

SEQ ID NO: 3062 - DNA, 121 bp, Gadus morhua
caacagatggtttacgtgacccgcgacataagagggcaaagagattccgttgatgttgatmatggggttgatgttgccgagggtgtagtactatcggccgcgaccacgctaatcccgcggc

SEQ ID NO: 3063 - DNA, 103 bp, Gadus morhua
actttactatgtaaaaatgtctaagcatgtcattgttgaagcaagaaaccttctatcagamattcttatttgacgtcgaataaagtgaatttgttaaagattg

SEQ ID NO: 3064 - DNA, 121 bp, Gadus morhua
aggtatgtattttttgacaatttgcacttataggctttgctggggccgtagcgccatggamttaacattctgtggttgtaaataattgaaatgaggtataaatatgtgtgcagatcaaatc

SEQ ID NO: 3065 - DNA, 121 bp, Gadus morhua
cgtgaacctaccaaaggcccttgacatggagctgaggggagacattgaagactgcctcatygacattgtgaaatgttcctggagcaagcctgctttcttcgctgaaagactgcacaaagca

SEQ ID NO: 3066 - DNA, 121 bp, Gadus morhua
gtcactatctccgccccaaaatactcaccaatctgagactgccatggagaggggtcaaccwtctggcctttagagatgtccaaagatttaggatagacaaacactactcctctgtgaaggt

SEQ ID NO: 3067 - DNA, 121 bp, Gadus morhua
atgacagccgccaccctccccctgacgggcctcctgtgcctcctgctcgtctgccacctgracgggcaacaaccacgcggtagtaagtgtttgtgtgaaaaaaaaggtgccaaccatgtga

SEQ ID NO: 3068 - DNA, 121 bp, Gadus morhua
tctagtccctcaagttagattaaaagtctgaaaccttaaagcagtagtccctcattttaaygttctaggccctaaccttaaatttctagtcactcagagagtctagtctcagagaaccatt

SEQ ID NO: 3069 - DNA, 121 bp, Gadus morhua
tcggtagctttggcgacctgagcaccgacgccgctattrtgggaaaccccaaggtggcyrrgcacggcgtcgtggccctraccggcctgaggacggctctggaccacatggacgaaatcaa

SEQ ID NO: 3070 - DNA, 121 bp, Gadus morhua
cctgaccgtcgtcatcgccgccaagatgggcaccaaattcaccgtggagacccaggtggcrtggcagaagttcctgtctgtcgtcgtctccgctctgggcagacagtaccactaggctgac

SEQ ID NO: 3071 - DNA, 111 bp, Gadus morhua
cacatcagcaaccatggttgagtggacagatartgagcgcgccatcattamtagcatcttctccaacttggactacgaagagatcggccgcaagtctctgtgcaggtmtgc

SEQ ID NO: 3072 - DNA, 121 bp, Gadus morhua
ctcacatgygcagctgctggccgactgcctgaccgtcgtcatcgccgccaagatgggcccygccttcaccgtggakacscaggtggcgtggcagaagttcctgtctgtcgtcgtctccgct

SEQ ID NO: 3073 - DNA, 1189 bp, Gadus morhua
ctcctggaaaatggaggctacacgaagcctactttattgtgatatttcaaaagagcccagtcagaaaatacaaatcctcgcaaaaaccttccatgatgtacctactattatcatctagtcaccttacaatgggctgtcattaaatgtattcactataaaaatactgagtggtctgttacaatcagttgagatataactaatactatagaaaaaaacagcatgacataatatacgacttaaatcaaaatgggacatttataaatcagggtgtttaaacgagttccaaaacattcaggtaagaactgatcaggaagctacacatgtaaaaactaaaagamaaacttaaaattaattatatccactacttacaatccatccaagacaaatgacaccatacatactagtagcaaatcatgggcagtgcatataacagtttaagctttattcaagtggactttatgcccttcaatacgtgcatatatagttcttcgtttcttacgcagtctcctagtgtggcagcattggaactgttaggtctggactgattgcattttgatcagccaattttaaagtaagatatttgtcgtacaaatcacatgttcaggtataggggccaataaaagcagaataatcctgaaaattaagaaaaggaaaggccaaaaacttgaattgtaatttcgttttgttataacaaacaacaatgactgttgcattacactcttaaaatactgacatgtggtgctttacattgtttttaccaatggccaaatgatgacattcatttttcaaaaccatgggattaaaaacactttcatcacatcaatgttccagcaaaggaattgcagtatcttttcccaactaattttaagtcaaaatagtgtttctttaatggatcataacgttgtcggttggagaaagtaaaacatattttagaggagatacagaggtacgtgaagtatctctgggactgtcaagacctattgtaatgtatttagcaatgatgttctccgaaggagccgctcactgctcaagggagaggtcctgctggtaccgctctctctatgtacttctatgctgtgtcttgacattttttccttcaattgaaatgttcatttgaatgaattctccccggtgggtcttctctcattccttgatgaagtgctgtgtaaaatattatccacaccaccag

SEQ ID NO: 3074 - DNA, 806 bp, Gadus morhua
ccatggtttccatagcataatttattactttagccaatcaattatacacaacagtaatcccatcaatgccataactttgaaaaagatacgataagggagaaactttgcatttagtatggaaagaggcttaaaatagataaacatttatcaaactacaatcttagcctctgaatcatgcccatttaaaactcaatacaaaacagcgtatataatacctcatatctgagtgacttcatcctcatattagctcccctataggtggagtagtggtttctttttgtcatgtaaaagcagcgcagaggcgttcactaaaaccccaaggatgaaaacaaataatggttaaccccttgtattgtgttaaataaaataaccatttattttgtgttcagtagatatatggatatacgagtcgaatcagtgctttgtgaaaaccattcctgcccgggcatatgtaaagctcaatgtcaaaaacctgccatttgtcttttcacagcatgttcaatgtacgggttcgaaaaaaagatttgtgaggatgagccacatgttcctaggtaactctttatacttaagtgtttcgtgaagttacttttataaagtgtttcgtgaattgtcttcttagtagttaagtgttttgtgaattgtgtccaawattgttttccaagttggaaaagaaaaagattccttgctttaaagtttttctcgtttaaaaaccattcatgtttttagacgtgtgacaaatgcaaaaaatgtcccataatgtgtcctcattcatcaaattattttaccaattattatcacattatttt

SEQ ID NO: 3075 - DNA, 1062 bp, Gadus morhua
aaaaaattttttggtgtgtacatctctttaatgaagccttaaaaatcaatatataccttttgcaaaaaatcaaatactccattacattaaaaaaaaactgccaatacataagtttaacaagcagacacaactgaatacctttgaaagataaaaccaaatgaccgatcactctgatcagtgtgcctaagacatgccgtccaaacaacaaagggccaagttaatgggtttagtttttaaatcggggcataattcacccaaagggttagttatattatatattccattcagctttagtcattttttatggatttattaatgattgacatgttgaatacttcggcatactagtttacggtctaaacacaacataagggtttaaaatagtgtcaaagtataataaaacacattgattaagtgtcataataactattgaatattacatttatattagctatattgaagcatttcatactccctttctatcattgataatttcccttcttagattatgttycacaaataccccatttttaatggttacacataaaagaagaaaaaacaacatttcgactaatgcagttattgtaagcctagcaaatcactgcaggcatccactagattactaatcaatcatgttgaatcagctcttattttggggtggtcatcttcttcaggttcttccttgtcgatggcggaacaggcgccaacccttcctcgctcgaacagggtcggagggctccacggccgttggtagaacttcgatggacggagtgttgttctcggccacaatgaaatgcatgctgctgcagcgggtcttcaccgcagtctcgctcaggagtctcaggatgtagggagcccatgccaaaacctcgaaactcctccatgacatagaagtcctctaaatagagaagctttccaatccaagggtcatacgtgaagtaatacatggcaaaggccaccacagtgaagccttctgagctttgctttttctttcgggacttcgccaacaaaacagtggtagaaaagggtgatcgccaaatccgtcttcgagcagttctttct

SEQ ID NO: 3076 - DNA, 848 bp, Gadus morhua
ttcgataagataaccgtttattaccgtcctgtgctgaagcagtgaacaataaaaacaatacacagttgaatgtatattcaacataaaacattgaactaaggtacatattaaaacatttcgtcttacacgatttctgcatatagtataaacatctgcatttgccttaccaattttatatagcagacagctagtaagaaaaatacaacggtataaaataaaacatggcaaagtagatttttttttaaagtaatccaagatccttttataaatggccaagaataagtttgaaattgagaaatacaaataaggcttacctttatgggcacttgttatgatgccaataaagagcaggagttatgtgtaattcttgttttcacacacccaggagggtgtaccgaaggtcaacacaggtaaacagcaataacacaagctttccagaraacaatgtgtactggaactattcatgatgacggtggcacagcaaagtgatatagttccaatgttggaaatggaaacagaacaaatgctacagcaagaactggataaaaaccacttattgtgtgttcacatatggagaaaaacaacacattactgtagattaataacaatctgttttatacaatataaaaggaagacacattaagtattgccatctttgctaagcagtccatctgaaggaaatgcaaccaaaggccactggaactttatcataacttatttcatttatgatggagtgaatcccagtaactgctcgatgggcttgtatcggcattccatctgcctcgagctcttcgactaaacttgcaagtttctccattcgcgacactgttgatcatgcttcacttgtt

SEQ ID NO: 3077 - DNA, 859 bp, Gadus morhua
atgggatggcagacttctttatttgtcactcgagttgcaaatccaaagaataaaacacgggaaccctttttctgaagctagaaaaggtcagccctgtgcctgaacccagggracaccaggaacacctgacttaagggttgtggttggtggggttaaggggcaagcaagtggaacattctagttaagcagattgaaaacacctttgcgtactttgctcccaactttgctttggccgtccgtcaaggcaaacaactggctttcacaactttagaccaacaaaaagtccgttaatggtaacaaaagaaataatccacatgtaggtttaagtaaatagcagtaaacttcatgacatgctcagttataatatatgcctaaatgctgctttccacttggttctaaatagcctgacatgttgcattggatggatacacaggtacctaatggcatctacttaaaagctctggttctaggctactgtccaaacggcttggacacgtgaacgaatgtgaactcttccttactcaacgggaaggagtgggcatgtttatgggtgtaagtagttgtattgaaacggggcaacacctgattaatggcagaaaggtatgtcagattggtgctccagtcccaagaactgttgtgcaataagaactgggttcactaaaaccatctggcctgcagtgccctctcagtaactacgaatccactgcatttaaacctgaaacacaggagctcatccatctggtttcaccacagtctaagcaaagcagaagaagtgcatgtgttggggagaggacatgaagaccgatttgaatgatgacagccacatgggtaaaacaggcattctaaggtgctttgtggg

SEQ ID NO: 3078 - DNA, 1248 bp, Gadus morhua
gtgttccaatctcaagactgcgagagtctttacgtagagtcgatgcagagggagtctacatgagacgtctaaggctgcgtgtattaagacgacgacagtattctgttcctggcccacactctttgtggcatatagatggccaccataagctcatcagaatagagaggatgtggagagatgtttatgaacatggcctggacctcttctatcagattttcacttcattgcaatatcagggaacactgaatccagacaatgaagtccatcttttcgcactgcaccggatcttccttccactaattcagcaaagcctcgactctttccgagatgcttggaactttcatggtcttagaactgaaaggaatcagtcgccacagcaactctggagaagatacagagagcaaggccctatggaggatcctactgaggttcctgaagagtatgggatcgactggaacggacctcacagtcttcatggaggcactgtgtcagtccctgaggttcagctggcccgtgagctctcagatgaagaggttgccattttgccagctccaggagtttctttaactgatgcacttagattatacgtagagactgtgccagttttatcaagaatcatagcagactgatgtccaacccagtgttttatttgtttattagttttcaaagacactgaacttgtgtcaattgacctgacctacttaacagygcattcaatgacatctgtctgaaaaaaattaaacaagtccaaatccagtctgtgcactatttatggccagagacaagtgcttcctcaaaatccatgtaggttttgaaatgagctggcagctttagtgtttcgaagcatgtggaggacgtcagaagggttcccccagtaaatctccactctcagtttgggaggaagcatctcccagccaacccagagtgtcaacagctgggccagggtacctgatgaagctgtggtcaatgaacaaccttagaaagccagtgacgcggcacgtggactctaagtcaaagtcttcatcatcactgtcctcaactggccatgtgattttttgtaggagcatctggggtgtgaactgcatttcagccattttggggaaaataagtgggacaacatctggcctagatgtcagcaggggccataccatcacatctttcagtccctttctcaactgtttgatctggcgcatggtcctcccaatgactgcatggagtagaagtttgtcatgtagccatctccgattt

SEQ ID NO: 3079 - DNA, 764 bp, Gadus morhua
ctaggtgctggggggaggtgagctttattgatgtacacactatacaacattgctcgctaacaagaacagttgttcctctgctgagctgaggataaagctccctccggtctttccggaatcttgacatttgtttataaactgcgatgcgaggcactggtcacctgtaaggaaagtttgccaaaaaatgggaattattaaaccacttattcccaactcttattccctctttttaaattaagtttttaattcttttcaaatgattgtacttcaacaaacgactcttttcacatacggtttttctattgcgtaaagtatttggtcaaaaaccttgakggttaattgtttcatcaagtatgtacattttgatccaaacatggacaaaaagctttttcgtgaaacaaaaaacgatgccagaaaacaggatatcaacattaaggaaacttccctgcacggccaaaatgtataaaatcctcaaagaaaaacaggcaatataaataataataagtgttaaaatgactctaatcttatgtcagtgatgaatgcattggtcagaacagtgttatatcatgattgcaggcgtggatataatatctcctaattcagtgacttaaggaagaactcacagtaaagttaaggattttaaagggaaacgattggcaaagacaaaacaaaaaaacattctataagtacaaagtccactatgtctgcaggcatacatagtgaagctgtgggtcagttctcaggaccagcagcgtacaccagtg

SEQ ID NO: 3080 - DNA, 1132 bp, Gadus morhua
cccccttttgggattggagatctttattagttgaaacattaggagaaataaaatgtgaacctttacaaatcaacgcaaacacaattattcactattcaaactgaaaattaaatccagaggattctgtaagctttgatattattggagataaactgaatgaaagagtgtggaatttacacatacaaattggacccacctgatgcctttttgaagaaaatgtaaaaaagaaaaagtgttaaaaagaggtaacaattgataatgatccacaagtctgtttattttgactctgaaactaaatattccaaatattccaaaaggaaaaaaatatgrcaatgatttgtttggtattttgagtttcgtaccttcagccaaggtttaatttaggagactcaactgtcactgcgatcacaaaaaaattgtcaaagcacaaatgttcaaccgtgtttagtttggcaaaaaaaaaaatacatcaacaataaatatattactttgccaggatactgctcatcgacggctggtgagacaatgaaataataaatgtgaatcagactacgtgcaaaatgcagtcatgtcataaagaacatctgatcatgtagttacatattcacaggtagtggcattaaacaactttccaaattgcttgtgaatatcaaataacacattctactttcggatgtcatcctcaggcagccttcatgatcaattttccaaaagctgtttctgaatactgaggggatatcttatattgtatcttataatataggctgtgattgataggaaccactatcaattccatagataatggtatagcatgactatttacagcagaggtgagctgcggaaggtgcatatacaatgtatgatgtctataaaaaataaacagtgtcaaacacctctatatgaggtaatattaaagggaaaataaaaacaataaatattagaagagttcacttgggttccagggctttttgtgcttctctgggcttcaccacaaaatctctgtacatcgagtaaattgacaccgatagtccatggcttcccaccaacgaaagcccctgggccatttacgcgcattgtggatccagggtgcacggaccatcttgggcatccccgcgactttcatttttataaa

SEQ ID NO: 3081 - DNA, 675 bp, Gadus morhua
catgaaacccttgtctccaacctatcccgttgtctgtctagcatgttttcaatgaaaatccttttttttttagatcttttaacattctttattgtttgccatggtttaataataataggggaaatgtgtcattacttactgcagcaagtcaatctgaaagtaatgggggcagatttasaaaattaattacttttttacccatatggtttgttatttaaattctttttttatatacaggaaagaagtggttcagtgtatggagcggtttctacactatgaatatagtgaggctatatagtgggttgacgtaaaggctttccgaatgacctgattataatcaaacggtgtgggtgaatgtgaatgtcttcaaatcccaatcattggcagattcatctgacattcaaaggtttctcaggggaatacacatccaattaagaaaaaacttaaatgcactccagtgttttcttatggactcattagtgaccttgggagtttgaaatagaatctacacgctaagcatcagtattcacagacctgcgggtgttttgttgagagactataactgactgcttgaactgatctgcagtgttcttcaattgttcaagttcattcccatttgtaattggctcacaacggttcaccatttggagtttaataaatttgaatgtgagattg

SEQ ID NO: 3082 - DNA, 773 bp, Gadus morhua
ctttcagtgacatggtgttcatggaggctatgtacaaacaaggctacatcaggaaacaatgtgtggaccactacaacgagatcaaaggcattagcatttgcgagttcctgccgccccatattgtgatctatgtggaccaggcagccgaggaagtgcagaagaagctgaaacaaagtagccagtctcatctgcagaacgtgcccctggcgtatctcaaggcaattgaagattcgtacaagaagaacttcctgccaaagattggcgaaacctcagaagtgcttgcctatgatacagttcaagcccaagatatcgaaagggttgcagaagacatagagtatttgaagtttgagaagggaccatggttggatcaggatgacgtcagctaccaccacatgagaatgcttgtggaagacaaacacaaggtggccaacctcaccttcatccccaagttcctgccggaaatcaccattggcgcccacgagtacgacgaaagctactacaagtttaaatcgctccccgggaagaagtacgcagaaggttataatgaggacgtcggagacaagaacatctggctgaagtaaacaatggaggcamcattctaaagttcatttttcttttatgcacaaaatactctgatctgccccatgggcagagaaaactgatgcccatgtcctatttcagaacatgcactgcttctgttatagtctgtctgcattaaggagaattatacaccctaacatgtatgtattaaaaaaacgagatccatttaaaaa

SEQ ID NO: 3083 - DNA, 860 bp, Gadus morhua
attccgggacaaagaacatactttatttccatacttttgatttagaaaaacaaaaacgatgcactcataatgacaccaagattttccatccgatttatcacagataaaagcctaaaagaatgaaaacgacgtcagcaatcatttgtagacgagcgatttgtgagtgggttgggatttgcagcactagatccctttgctaaatgaaaccccaaacgaagagccgcaccaaaccatctctgagcatggctcaaagtgagacaactttccggtcattcgacttctagaagagacgatagtttgagtgggttggttttcagcacactaactagtagagagtggtgctgcaaatccctccccgacttggttagggcagcaaacgccttaaaaagcaggccagcgttgaccaaagtgaccaaaacaaaaatgagaagcaaatcaaaatctattaatacactgattcatgcatgtttaatggtttgatcacaagcaarctaaaaatatatcaaatcaagtcatttctgatgcggttgtagtgctgtagtgaaggactagagggctgttaaactagtacacacaggtacacagtgtctacaaactggtacagcggagaccgacacacgaaacacacatggacaggcttcaggacactgaattgtgcaaccagcacaagtttatttccagcattcataacgattaacctaaattacaacacgggtgactatgcagcatacatttcaacaggcatgtcaaacatgtggagaaggcctaagtgcattgatatgaagccctcttcagccagagagcgatccctttaccaaacataatgcccacagagactatccgtggatgaggaactatgt

SEQ ID NO: 3084 - DNA, 649 bp, Gadus morhua
cttaacaatataaatctttagagtttatttagggaagataaaaggggcagtctttcattgcaatacaaaaatatctgaaaccattggtatatcaacttcctatgaacccataatagacattagcaatgtgggcttttagctcagtggcgagtggccagccataacaatgtccctttgccctcagacattgctgagcaacccactctggccctccagaagttgaccaaaaatggatgcatcttgcgaacttccagtgacacaattcacaagttatgtcaacgtaaaagtttcagaaccaaagccttggtcaataaaggaaaagtarcttaacaatataaatctttagagtttatttagggaagataaaaggggcagtctttcattgcaatacaaaaatatctgaaaccattggtatatcaacttcctatgaacccataatagacattagcaatgtgggcttttagctcagtggcgagtggccagccataacaatgtccctttgccctcagacattgctgagcaacccactctggccctccagaagttgaccaaaaatggatgcatcttgcgaacttccagtgacacaattcacaagttatgtcaacgtaaaagtttcagaaccaaagccttggtcaataaaggaaaagta

SEQ ID NO: 3085 - DNA, 697 bp, Gadus morhua
cgggacgtttggattttatttgacttatcaaacggctgtacatctatttgcctttcttggccttgatcttcctcaggtagaactcgagctccttgccttccagtacgtagccgtcggccctgccacactggccgggtctggaagcaatgcaagcaagaagttttccctgctggaactgttcctccaagaggggattgactttgctggtctttttgcgctcatcaatcttcttctgaatctttttggacctcttcttgttcagagtctcrtcctcctcagcggtcagcttagctcccttcttgcgtcccattggagtggcgtagtgagcctcgtaccactgcctgaagggaagactgtcaacaaggacaatgcagttcttcaccagggtcttggttctcaccagctcgttgttggaggcgttgtagaccacatctataatcctggtcttgcgtgtgcagcattctgagccccaagcaaagttgccaacgtcaagcctgagagccctgtatttcttgttcccaccacggaccctcaccgtgtggatacgacgaggtccaatctttgtgtttgcgggtgggcgaccgagctcatacttccttttcttgtgataaggcttgcgtttaccgccggtcttgcggcgtttatgccagttgtccctcgagatacccattctcaggcgccggctagaaagagcccc

SEQ ID NO: 3086 - DNA, 771 bp, Gadus morhua
tttttttggtcttccattgaattttaataaagaaatgttacataggatccatcagtgtacacatttgttgcatgatagaagcgtttagaaacacaaggcacaaaaaggcacaaataaatactagaaaaataacaaaacatataggtgaataatgaagttacagagggtgttaattgcagctggaccgttctcattactcatccatgagctygacaaagttttcttacattccatgtcatatatacattccaaatagtttattaaaatagaaaataacctccatcacagatgaactgttcataaaataaaataagatatagctatattctggtttaccatgttactacacatttaactgtaatatttttgcaagcaacaatgttttattgtataagtgaatggaaatgcagggcttgaatatattaataaatggcttggcaatcagtgaggtttatgatgcacacataagggagggtcaataaaaaccaaattctgggccccaaatcttcatggatgtaacatttcaggtatttgagtgtcatgtcgtgccggaataagctcactttgagtttacaacagtgttctgtccaaagtacattcctataccatctgcatcctgttaagtcaagaccgttttacacaaatggatgttttttcagctattaatacagtgttgtgcaagcgttaccaaacactggtacacacaattattgcagtgactctgcagcttgtgcaaatactgtcctgccgtctcaaaccttccatctctat

SEQ ID NO: 3087 - DNA, 775 bp, Gadus morhua
cgccaaaacctttattctacgtcaggatcacacgtttcattttatattcctcattccttcacaataataatgatattgcgaagttaaataaaaaaaattgcaaatctttcatcaaaatataataacatgttggacatgtttataaagaaccagattacaaaagcacatttttaaaatgtcacattaatatagcttaaaaaccctttggatataatgtcaatccaaaactcaaaaacaaagattattatgtcaacacataataattagacaaaagctaaagaataaaacattgattgctggagcagtgattagatatgctgtaggtgagagatttgagaggcgtaacttgagtgcataggcccgccttccatgcttggtttgaggaatccaaattacctgtcaatcaaaggtgtgtgaaggcaacgcttctctttggtggaaaagggagtgatgtttttaaactttttatctatttaaatcattcaattatcttttaaatcttttaaatcttattttgctarctctcgttacaactctcaattcttaactacagcatcttaacaagtagtaaaagttaaatcagcgaacaacctcaggattatttaaccacgcttcgagttccgcagagtgccttggtcgacttcctttcttgtgacgcagaactaccaggcagggcgtgtagtcagcgtagtgcaggactttaatcattcatatcccagccgtggtctgtgatcctccccatatggttgaccctgcaggcatagcgggccccctc

SEQ ID NO: 3088 - DNA, 749 bp, Gadus morhua
atgaaacttgctataaaactttattggcatcagaaaaatatacactatttagaacattcaatttaagtcatttcagctatttgacagactcatcacaagatgatctcatacatagaagataaatggcagagggaaagctttttgtactacctatttaaaaaatctggagatgtgaaatcaaaaataatcataactttcagaagyagttgtgaacccgtagtcttttggttcagggctttggccaaatgtatgtcattgagttcaagtcaacaaggaacgtgtgcaggcgtgttcgatatactctcctggtctgctacaggttcatacgccctggaatgtcgatagaggccatagtgctgaaccatgaacagtacatcaaacaaaatggacaacagtcccagtccgaacttcgtagggtcaccaaatatcaacccccactcatcgttattataagattgcaggagcatctgtagaatgctgagcgttccccccgtgaagtctagcaccacattcccaatgctccatccttcagtactcttccgtctgtaattcatataagcctgtggtatgtattttattagagtgattccaagtttaatgtaagagaaatagtaaaggtaatccagccaggtgatgacttttgctactgcaacaaacaggctgacgagggcaaatgtccagctgatgagcaatagggcccatgagatgcgggacacagtttgactgcccctctcatagactgcagcttg

SEQ ID NO: 3089 - DNA, 808 bp, Gadus morhua
tctcatgggtctgtccaccagcctggcggaccaccaccaggcctgccattcgcccaacatgacggggactgttgccatgtccgatttgaggaacggagccaaagtagtcgccgaatttgtttacgatcccttggcgaggaaactccgcatgaagaccgccccctggcccggcttcgtcacgaccaactcgtccaggaacctggacctgctcctgctcttcgaccagggggtcttctatgagatcgacagcaagaaccagagctgtgagaagaaggttctgcactcggccgtgagctccatggaggtgccacccggcgccagyttctcagtgaagaccactctggggagcgagactgtggccggggaaggactgaccctcagcatgtggaagggcacggtacccaagacccaaggtacttactgcaccgctgtcaccgaggggtgcatgcccgtcagcaccacctacacctccaactcctccatcatcatagtcggccacatccaggtggagactgagatcaaggacccggagaagctgtgcgtgccgtcgttctgcgagggcgaggaggtggacacacacgacggctccacccacaccttcttcaacctgctcttctagcgctccctctgcccttggcccctgtgacacgatgcagtaccgcagggggccactagagggagcctctagatctctcagctctgtaggtccgctcctgggaccgctgtggtgcctgcagcctgtagcacctagcgctgctgctcacagtagttagaagtctttgaaaataaaaatgttttaagacaaaaa

SEQ ID NO: 3090 - DNA, 1125 bp, Gadus morhua
cacagcacttcatcaaggaatgagagaagacccaccggggagaattcattcaaatgaacatttcaattgaaggaaaaaatgtcaagacacagcatagaagtacatagagagagcggtaccagcaggacctctcccttgagcagtgagcggctccttcggagaacatcattgctaaatacattacaataggtcttgacagtcccagagatacttcacgtacctctgtatctcctctaaaatatgttttactttctccaaccgacaacgttatgatccattaagaaacactatttaaaattagttgggaaagatactgcaattccttgctggaacattgatgtgatgaagtgttttaatccatgttttgaaatgatgtcatcattggccattggtaaaacaatgtaagcaccacatgtcagtatttaagagtgtaatgcaacagtcattttttttgataacaaaacaaaatacattcaagtttttggctttccttttcttaattttcaggattattctgctttattggcccctatacctaacatgtgatttgtacacaaatatcttactttaaaattggctgatcaaaatcaatcagtccagacctaacagttccaatgctgccacactaggagactgcgtaagaaacaaagaacaatatatgcatgtattgaagggcataaagtccattgaataaagcttaaactgttatatgcactgccatgatttgctactagtatgtatggtgtcatttgtcttggatggattgtaagtagtggatataattaattttaagttttrtcttttagtttttacatgtgtagcttcctgatcagttcttacctaatgttttggaactcgtttaaacaccctgatttataaatgtcccattttgatttaagtcgatattatgtcatgctgtttttttctatgtattagttatatctcaactgatgtaacagaccactcagtattttatagtgaatacatttaatgacagccattgtaaggtgactaatgataatagtaggtacatcatggaaggtttttgcgaggattgtattttctgactgggctcttttgaaatatcacaataaagtaggcttcgtgtagcctccattttccagg

SEQ ID NO: 3091 - DNA, 843 bp, Gadus morhua
accccaactcggacttggaggaacagttcccacttccaccttccgcgggactgtttgtgtcctgtcgaagctcaccgtgcaagcagaccacctcacgaaccgctacaaaagggaaatcgggggtgggaatttcatgagatagggtttgcataagttaaaccagactgcacacttcgttaagacaggcttgttttcaaagagaacgtggccgccacctctactaaaataactgcaatggacagcaatctgaccagggccttttctttcccattcctttcaaagtatgcgccatgccaccctttccccaacgtcagccagctccactaaacttattttaaacacctgctgtactgtaccctgagcctttaggatctttttaaactggattatttgcatcgtcttgaggatatagacacttagtggttatgcagaatctccccctagtcgttcatttcaagtttggcagggaattaggtcaacggggyactgggtgggactgacctcaccttaggagcatttttaattctggctattctgacacaaaaaaagtgagtaaaattctgggctttaggtccttgtcaaaagacgttatatatttcaacatttccaacccagtaattgtaacatgtgccttgaattttatatgctatccatgccctctccattcgattcctatctggtccctcttttcagaaattggtttaacagttgtaaccggtgttgttatggtaaccacttatttgttttgtccttttgaatatttcatttttttataaatatatatattgcagtccaaatgaataaagaattggaaataaacatcctttatttgtgtactttgct

SEQ ID NO: 3092 - DNA, 1311 bp, Gadus morhua
cgggaaagatccaacagtctcttcccttctacagacttgcgcagattgcttaactaaaacgtagttaaggatctgttgttttgtccttagttactgacattcaggcgtgatgtacatcgcctgtgtgtgttgttcatgtcactaagtggcttagctcgatgctagtatgctgggttgtctagtcgtcgagtagaataaggaggagcttggacccgtgtgatgtaattctttgcccgactaagggacaacggttcaactgcctagactgacaaatgggaaaatcaaatgggagataaaaatatcttcctaaaatgccgacaggctgttttgaggtttgaatacagattttggatgtggcaaagaaactgttgaaaatcgctagcatgtcctagcttagcgcttcaacgtttgattctctgacctttgttgcaaggcaattccatacttaattaggcaacaaataaatgttttaaactgtagtactcggactgataaagatttcccccagtggtgtttctaatgtcacgttttaacgatttaaaattatacattgtttctaaaggtttttttttttagtatgaagaaaggaaccaactggaatatatacaaaagtccaaaaaaactactttactttaccctacaacccaggcttatattatattattkgtgttcatcattttagagtttgggaggtagtagatttacaattttaaataaaggcatagcaacaattctgaacatgtttgcacaaggtactcaaccaatgcgtacaagaaaaggttccatattattccatacttatttacattggaatgtttcaagcaagtacactgagtaagcacgtacaatatgttctcaatgtcttacccgatgactgtttagtactaactttttatttttgacacacatttgagagtttattgttaaacatttctgttaagtgaatcgaacctagtccctggtttcgttggcctgtacctccatgcccacaagcgcattggttcagtgggatggtggaagccgtttatggtggactagataatagcggatatcaggcagatggaaagaagcacagttaagtgttttacggagaaggcaggcaacgttctgggaccacagatttaaatatatatatgtaaaggcattttagctatatcagcattcattttacagaaagacaaaaaaataattcatgagaaatcttagttgtctttctacagcataaagaaaaaaatctataataatttctaaaaacaaatgtaatgatgatgataatgatgaaataaatacaatgtttttattgtggcaaaa

SEQ ID NO: 3093 - DNA, 585 bp, Gadus morhua
acgcacagccaatgaaaacaggcccttcttttactttgtaaaacatttgcattaaacataataaaatgtaaaaattgtaaatgattgttaacacacttgacatatgtacaaggaagagggattcagaagttatttgttaaaaaacacaaaatggctatttgaatscaatgttttacaggttatgaggatggggctcgtctttgaggacccagcgacgtttgttgagtttaagatgatgctttcatcccagtatgagggaccctcaaaggaagttggggttgccatgtctcccgcttcaggcaaggggcggtcagatgacaacaaactgtcgaagcaggaaattactgccatatccggagtaccgcaaaatcagaaaaacgtttatttctaatttcttaatgatttgggtcctttaatataacaaaacctcactgttctgattttaatttagacaaaatgactcttcctctgtactatgcgtcaaaggtccatggtcagctttttaaatgttgttgattttctgcaggatgtaacgattcaaacagttcggctctaggtctggatggggatggtgttctatgcatg

SEQ ID NO: 3094 - DNA, 1129 bp, Gadus morhua
gcttggatcagattggttttattcggggaaacactgatgcagcatagatgtgtggctgacagctcctcctactcatcccctagacaacgataggggcaagtagtaaaacagtaatacaatactctgctaataaaattaggtggatgggcctcatttgagtaggaaaaatcgagtgtcgtggcatttgctgcaccctctctaacacctacacattctgtggctccacttggcacttggtaacaggagttcacttggttggtctcgaataataatctccaaatcttttatctcggaatctctatagatttgggatgagctatttaagtgtttatttcttttctttttttgaatgttttctttacactttcttatgcatcacatcttattttaagtagtgagcgytaattgagtggttgctcccagatacgttgtttatgaaaatactatgtaagtcaatgaaatggattaataatacaagattaaatccccctactctattcacagaccctatcgtactttattacatttaaaaaacaattaataccccatgcatacgtttctgttatttcctttgatctagtctagtttttattcattatttctaacaacataaatagtataaataaatgacatttttgctaatttgatgattaattgccacatgtccctggtgagaatacatatgcatagctagaggctacctggtattgaacttgccataaacacattcgttacaatacacaatacactttaaatatactttttacacatcactgcgaatgggttcaccgttgaacaactaaatggctctttctatgtttctccctcatactgctctagcagatatcccttaagccagccgccgttcctgtctctaccaccaggggtagagaccgagacctcaatttaaatggggtccaatggccagttcgtagtaagagcgggttctctcgcttcccaaacggctctttgtttatttacttttccctaatcaaaatgtgttcatattggttatccattcccgtcaatagatgttaatggaggttacttttttatttaccttttcgacttatgcctgttttttgattcattgtgcctaggtctaaataattattcaatacacggtgtt

SEQ ID NO: 3095 - DNA, 964 bp, Gadus morhua
gtcgacacttgtgtttaatatatccatttttttatacacatacaggttttaaacaccaggtcaatgcatttcaaatgtcgtttctttcaaggaatgagcatgttaaaacatatcctgtgataactgttttgcaaaaaatgtagcttattattgaaagtaggccaggcatttagccaggcatgtataagcactgatgagaggggcacatttccatatccctcaatctgcctttccaattgaaccatatataataaacagagggcaaacacatatgcacccgatgattaagcctcagcactgccctccagtgtacacttgtatagtgttatagtcagaagggtgttccacttccagaacacaaaataaaaaaattcaatcctgcatgttatttctttgtaaacatttatgcaagctgacaagggtcacctaagggacttcttttggtatggtttagaggcaaagtctcacacacaaacacacacaatttacttaattatatagaacagrgtggcgatatgatgagaggaattagttgagttccaaatattttttacattcgttttttagacttcaactaaacctatttcatgccagtttttctccggtaaacatatgatgcaatgggcatgcggtccatttggcagaaggtcaatggcatgttcaaccaaatgagactcggtaatctacggtaatcaaatgatatcagaaggggaggaaacggacgtctccggagcctggactcaagctaaatccatcttctcgttcatgtactcatttgggtctacactatcatcgtttaggagtcaacctctatttcacggagaactggatgccatgtttgtggaggcggtcgatcagcgtagtcttgccgaaagctgctccgggagtgtagactcctcccgtcctgggcagaacattgggttcattgacggatggtgagcgccgcctggaccatggcgatagg

SEQ ID NO: 3096 - DNA, 684 bp, Gadus morhua
gggggacacccacattgttttccttcccctacattgtttttttgcatctggaacagatttctcaaaatgaagctttacctcgcagttgccgtcctgttgctggctctcgcaacgcaatcagaggcccaggctccggaggaaccgacccctgcgggtcctgatagcattggggacaagttcagccsagttcggggacacagtggccgtgctcggccaagacattgccacgaagacccaggacgccttccagagagctcaagacagcgagtttgtcgtcaaaactaagacctggttcagcgatcagttggagaagatgaaggcaaagttaagcgagattggacaataagaaggagaccaattgtctgcaatgagccaaaaccctgtcagtggtgccttgtgtggcgccttgtgtggccctttgaccttctgcctcccccccctccgcccccactgggttttggccgcaaagagggttgactgtatgcatggccttatgcccaatacaccttgctttgtatcgctcatataatctttgtacacattttgtggaaaaagtgcaataaacatatgagcaataaagatcattttatatatatacacaatacatatatttcttcatttcaaaatctgtaactaaataaaatatttttgaaagaatcaaaaattctgaataaaaatttgaat

SEQ ID NO: 3097 - DNA, 774 bp, Gadus morhua
actattttctgattaagatgaaactcaagtgctccctttttgcctctatgatacgatcattaagaatgcagtaagataatgcatgtcgtgacctttcagctgactgatatgactcattgagtgtcattcagcgccttcccatccagcaatgtaacagatggagcccagtttgccttccaagtctattcctctccacgttgtctatggtgaactgacccttaatgcctctggtgttataagccttatttgaccgtctcggcaacccttttgtataaacgatttatcttcctatagctcgcattttaaaagaaccstccaatgtttttgttgcggagtccttgacttttgtacgagctgtatattcactcagatatcttggatctttagtgagtttaaccgacccgtccaactaagccataatcaaaaccactgaaagagtctggcccttcagatcaatgtaaagcagggaccccatgtccgcctggataggcttttgtattttccttgcatgctgcatgatctctggtttgggcatttattgtttgaagttttcacactgggagcataggagagtagtaatattcaaccttgcccattcatcaaccgtgtgacacattttatactctaaattgtttccttaccaaatgaagtcaagatgaggtccttggtattttgtaaacaatgctaagacaggcaacagctacatttgcatgccaatgtcaatgatatccaatgttgaatcaagcgctgtattaaaatgttcttttgaggttg

SEQ ID NO: 3098 - DNA, 769 bp, Gadus morhua
cagtcaaagtacatttattaagcaactgcaaacagagtgaacaacattgctcaacgcattacccattttatttttgcaacaaacctgatggtcaaacacgcatgccaactgccattcatacaacagtcccgtgtaaggcagtacccatccagacagttaagtgcttcttttttaggcggctcaataaagaccatagaggggttttaacaacaataagtcacaccaggttgccatgttggtctttctaagcggctagtacaggggaagggcctgaggtttttttccgtgccgtccacgccaggggacgygaagcatcgttcaggcgcagattccgatcactccacaggccagacgactaccggcgttgccggttttcaggctctcctcgttgccacctttgccaagatcgtcagccttctcgtgaatcaccatggttctgccgacaatggaaaatgggccattaaggctgagcatcttatcggtgatgtcgatcttggcgactttatcagctccggcggtcacgtttcccaggtctccaacatgcctgtctacatcgttaggcccagcatggtcctttttgtgggggttgaagtgaggacctgcactgatgcacccattagtgttgtctccaaacgcatggacgtggaagccatgctctcctgcagcgagccctgcgatctgtcctgagagcttcacgggggcgccgtcaccctcttgttcaaagaaaacagttccggtaacgtccccggttcccttcaacacacagaca

SEQ ID NO: 3099 - DNA, 1014 bp, Gadus morhua
acatactggacaaggcctttaccaccgctgtgaaacagtacaacaccaccgacagccaccacaacgccctggacaccattcagagcactttgggttgctgtggcatcaatgcatacacggactggaatgggacggcctatttcaaagagaacggcatcccaaccagctgctgtaagatcaagtactgcagcccggagagcctcaaagatctcgaacaggccgcgacagaggtgtacgagcagggctgtttctctgtggtgtccactaaaatggaagctaatctgggaatcatcgctggcgtctcctttggaatcgcattcttccagctcattggaatgttcctggcctgctgtttgtcccgatacataaccaacaaccaatacgagatggtctaggaacgaaacacagatgtgcaccagcagaggaaaagacttcaatgtttttctcataattttattattgcgtgtccacgtatattgttttagggacaaaaataacacttgctgcttcttttatttgacgtacccgatgccaaccaagcagaagagaactkctatgaattgacaagggatatttgctgcttttctgaaaggcaaaatgaaaaagggagccaattcatttagtagtaaatataatgtttgatttaagttaccatttcagtcagtcgtaccctgccaattggtaaacatttccaatactttcaacgattgtgttgatgtgctgcctacaatgttttgtaattttgctatatttagtctgtggttatgctattaaaaaagctgatatgcattgaagcaaaaccatgtgaattttattatgaattctgagtatgttgcttatataaagggtaaatatgaggttagagacatttaatctcatgctgtatttctccataactaatctttatgacggttgtcgttattgttattaatttgtcataaataattgcctgttaagccctttgaggctatttgtgattaagggctatggaaataaagtttggtcgatttgaac

The invention claimed is:

1. A method of forming a stock of Western Atlantic codfish with a quantitative trait locus (QTL) for a desirable growth production trait from a population of Western Atlantic codfish, the method comprising:

a) genotyping the population of Western Atlantic codfish for one or more of the following single nucleotide polymorphisms (SNPs):

SNP marker cgpGMO_S833, wherein presence of at least one C allele indicates the presence of a QTL for increased weight;

SNP marker cgpGMO_S834, wherein presence of at least one C allele indicates the presence of a QTL for increased weight;

SNP marker cgpGMO_S268, wherein the presence of at least one A allele indicates the presence of a QTL for increased weight;

SNP marker cgpGMO_S1183, wherein the presence of at least one G allele indicates the presence of a QTL for increased weight;

SNP marker cgpGMO_S2158, wherein the presence of at least one G allele indicates the presence of a QTL for increased weight;

SNP marker cgpGMO_S1039b, wherein the presence of at least one T allele indicates the presence of a QTL for increased weight;

SNP marker cgpGMO_S1830, wherein the presence of at least one A allele indicates the presence of a QTL for increased weight;

SNP marker cgpGMO_S157, wherein the presence of at least one C allele indicates the presence of a QTL for increased weight;

SNP marker cgpGMO_S870, wherein the presence of at least one T allele indicates the presence of a QTL for increased weight;

SNP marker cgpGMO_S419, wherein the presence of at least one G allele indicates the presence of a QTL for increased weight;

SNP marker cgpGMO_S352, wherein the presence of at least one G allele indicates the presence of a QTL for increased weight;

SNP marker cgpGMO_S920, wherein the presence of at least one A allele indicates the presence of a QTL for increased weight;

SNP marker cgpGMO_S152, wherein the presence of at least one C alleles indicates the presence of a QTL for increased weight;

SNP marker cgpGMO_S1089, wherein the presence of at least one T allele indicates the presence of a QTL for increased weight;

SNP marker cgpGMO_S1039a, wherein the presence of at least one G allele indicates the presence of a QTL for increased weight;

SNP marker cgpGMO_S814a, wherein the presence of at least one C allele indicates the presence of a QTL for increased weight;

SNP marker cgpGMO_S1425, wherein the presence of at least one G allele indicates the presence of a QTL for increased weight;

SNP marker cgpGMO_S1810, wherein the presence of at least one T alleles indicates the presence of a QTL for increased weight;

SNP marker cgpGmo-S1644, wherein the presence of at least one C allele indicates the presence of a QTL for increased weight;

SNP marker cgpGmo-S811a, wherein the presence of at least one T allele indicates the presence of a QTL for increased weight;

SNP marker cgpGmo-S1622, wherein the presence of at least one C alleles indicates the presence of a QTL for increased weight;

SNP marker cgpGmo-S391, wherein the presence of at least one A allele indicates the presence of a QTL for decreased gonad weight;

SNP marker cgpGmo-S2288, wherein the presence of at least one G alleles indicates the presence of a QTL for decreased gonad weight;

SNP marker cgpGmo-S1579, wherein the presence of at least one A allele indicates the presence of a QTL for decreased liver weight; or SNP marker cgpGmo-S849, wherein the presence of at least one A allele indicates the presence of a QTL for decreased liver weight; and b) separating codfish with at least one allele that indicates the presence of the QTL for increased weight, decreased liver weight or decreased gonad weight from the population of Western Atlantic codfish to form the stock of Western Atlantic codfish with the QTL for the desirable growth production trait.

2. The method of claim 1, wherein the presence of homozygous alleles at the SNP marker indicates the presence of the desirable growth production trait QTL.

3. The method of claim 1, further comprising using the stock of Western Atlantic codfish for breeding stock or aquaculture.

4. The method of claim 1, wherein the SNP markers are on linkage group 7 and codfish with the QTL for increased weight have increased weight, bled weight or gutted weight compared to codfish without the QTL.

5. The method of claim 1, wherein the SNP markers are on linkage group 11 and codfish with the QTL for increased weight have increased skin-on-fillet weight or skin-off-fillet weight compared to codfish without the QTL.

6. The method of claim 1, wherein the SNP markers are on linkage group 23 and codfish with the QTL for increased weight have increased skin on fillet weight or skin off fillet weight compared to codfish without the QTL.

7. The method of claim 1, further comprising obtaining a sample from a codfish in the population of Western Atlantic codfish and extracting DNA prior to genotyping the codfish.

8. The method of claim 7, wherein the sample is a piece of fin.

9. The method of claim 1, wherein genotyping the population of Western Atlantic codfish for one or more SNPs comprises detecting:
  an isolated nucleic acid molecule comprising SEQ ID NO: 2075 wherein the SNP marker is cgpGMO_S833;
  an isolated nucleic acid molecule comprising SEQ ID NO: 2076 wherein the SNP marker is cgpGMO_S834;
  an isolated nucleic acid molecule comprising SEQ ID NO: 1386 wherein the SNP marker is cgpGMO_S268;
  an isolated nucleic acid molecule comprising SEQ ID NO: 210 wherein the SNP marker is cgpGMO_S1183;
  an isolated nucleic acid molecule comprising SEQ ID NO: 1200 wherein the SNP marker is cgpGMO_S2158;
  an isolated nucleic acid molecule comprising SEQ ID NO: 49 wherein the SNP marker is cgpGMO_S1039b;
  an isolated nucleic acid molecule comprising SEQ ID NO: 833 wherein the SNP marker is cgpGMO_S1830;
  an isolated nucleic acid molecule comprising SEQ ID NO: 560 wherein the SNP marker is cgpGMO_S157;
  an isolated nucleic acid molecule comprising SEQ ID NO: 2120 wherein the SNP marker is cgpGMO_S870;
  an isolated nucleic acid molecule comprising SEQ ID NO: 1571 wherein the SNP marker is cgpGMO_S419;
  an isolated nucleic acid molecule comprising SEQ ID NO: 1485 wherein the SNP marker is cgpGMO_S352;
  an isolated nucleic acid molecule comprising SEQ ID NO: 2186 wherein the SNP marker is cgpGMO_S920;
  an isolated nucleic acid molecule comprising SEQ ID NO: 514 wherein the SNP marker is cgpGMO_S152;
  an isolated nucleic acid molecule comprising SEQ ID NO: 111 wherein the SNP marker is cgpGMO_S1089;
  an isolated nucleic acid molecule comprising SEQ ID NO: 48 wherein the SNP marker is cgpGMO_S1039a;
  an isolated nucleic acid molecule comprising SEQ ID NO: 2049 wherein the SNP marker is cgpGMO_S814a;
  an isolated nucleic acid molecule comprising SEQ ID NO: 434 wherein the SNP marker is cgpGMO_S1425;
  an isolated nucleic acid molecule comprising SEQ ID NO: 811 wherein the SNP marker is cgpGMO_S1810;
  an isolated nucleic acid molecule comprising SEQ ID NO: 622 wherein the SNP marker is cgpGmo-S1644;
  an isolated nucleic acid molecule comprising SEQ ID NO: 2045 wherein the SNP marker is cgpGmo-S811a;
  an isolated nucleic acid molecule comprising SEQ ID NO: 606 wherein the SNP marker is cgpGmo-S1622;
  an isolated nucleic acid molecule comprising SEQ ID NO: 1537 wherein the SNP marker cgpGmo-S391;
  an isolated nucleic acid molecule comprising SEQ ID NO: 1334 wherein the SNP marker is cgpGmo-S2288;
  an isolated nucleic acid molecule comprising SEQ ID NO: 568 wherein the SNP marker is cgpGmo-S1579; or
  an isolated nucleic acid molecule comprising SEQ ID NO: 2095 wherein the SNP marker is cgpGmo-S849.

10. The method of claim 1, wherein genotyping the population of Western Atlantic codfish for one or more SNPs comprises amplifying an isolated nucleic acid molecule comprising the SNP using a polymerase chain reaction (PCR).

11. The method of claim 10, wherein the isolated nucleic acid molecule comprising the SNP comprises a nucleic acid sequence selected from the group consisting of SEQ ID NOS: 2075, 2076, 1386, 210, 1200, 49, 833, 560, 2120, 1571, 1485, 2186, 514, 111, 48, 2049, 434, 811, 622, 2045, 606, 1537, 1334, 568, and 2095.

12. The method of claim 1, further comprising identifying Western Atlantic codfish resistant to nodavirus infection in the stock of Western Atlantic codfish with the QTL for the desirable growth production trait, the method comprising:
  a) genotyping the codfish for one or more of the following SNPs:
    SNP marker cgpGMO_S557, wherein the presence of at least one C allele indicates resistance to nodavirus infection;
    SNP marker cgpGMO_S943, wherein the presence of at least one T allele indicates resistance to nodavirus infection;
    SNP marker cgpGMO_S1596a, wherein the presence of at least one A allele indicates resistance to nodavirus infection; or
    SNP marker cgpGMO_S1071a, wherein the presence of at least one T allele indicates resistance to nodavirus infection.

13. The method of claim 12, wherein the presence of homozygous alleles at the SNP marker indicates resistance to nodavirus infection.

14. The method of claim 12, further comprising selecting Western Atlantic codfish identified as resistant to nodavirus infection for breeding stock or aquaculture.

15. The method of claim 1 further comprising identifying Western Atlantic codfish with a quantitative trait locus (QTL) for resistance to handling stress in the stock of Western Atlantic codfish with the QTL for the desirable growth production trait, the method comprising:
  a) genotyping the codfish for one or more of the following SNPs:
    SNP marker cgpGmo-S848, wherein the presence of at least one A allele indicates resistance to handling stress;
    SNP marker cgpGmo-S487, wherein the presence at least one C allele indicates resistance to handling stress;
    SNP marker cgpGmo-S975a, wherein the presence of at least one T allele indicates resistance to handling stress; or SNP marker cgpGmo-S525, wherein the presence of at least one T allele indicates resistance to handling stress.

16. The method of claim 15, wherein the presence of homozygous alleles at the SNP marker indicates improved resistance to handling stress.

17. The method of claim 15, wherein Western Atlantic codfish with the QTL for improved resistance to handling stress have reduced cortisol levels in response to handling stress compared to Western Atlantic codfish without the QTL.

* * * * *